US012496274B2

(12) United States Patent
von Maltzahn et al.

(10) Patent No.: US 12,496,274 B2
(45) Date of Patent: Dec. 16, 2025

(54) COMPOSITIONS AND METHODS FOR COMPARTMENT-SPECIFIC CARGO DELIVERY

(71) Applicant: FLAGSHIP PIONEERING INNOVATIONS V, INC., Cambridge, MA (US)

(72) Inventors: Geoffrey A. von Maltzahn, Somerville, MA (US); John Miles Milwid, Denver, CO (US); Jacob Rosenblum Rubens, Cambridge, MA (US); Michael Travis Mee, Montreal (CA); Neal Francis Gordon, Brookline, MA (US); Jagesh Vijaykumar Shah, Lexington, MA (US); Kyle Marvin Trudeau, Boston, MA (US); Brigham Jay Hartley, Long Island City, NY (US)

(73) Assignee: FLAGSHIP PIONEERING INNOVATIONS V, INC., Cambridge, MA (US)

( * ) Notice: Subject to any disclaimer, the term of this patent is extended or adjusted under 35 U.S.C. 154(b) by 1180 days.

(21) Appl. No.: 17/293,830

(22) PCT Filed: Nov. 14, 2019

(86) PCT No.: PCT/US2019/061535

§ 371 (c)(1),
(2) Date: May 13, 2021

(87) PCT Pub. No.: WO2020/102578

PCT Pub. Date: May 22, 2020

(65) Prior Publication Data

US 2023/0068547 A1 Mar. 2, 2023

Related U.S. Application Data

(60) Provisional application No. 62/767,394, filed on Nov. 14, 2018.

(51) Int. Cl.

| | |
|---|---|
| ***C12N 15/88*** | (2006.01) |
| ***A61K 9/1272*** | (2025.01) |
| ***A61K 38/16*** | (2006.01) |
| ***A61K 38/45*** | (2006.01) |
| ***A61K 38/46*** | (2006.01) |
| ***A61K 47/54*** | (2017.01) |
| *A61K 48/00* | (2006.01) |

(52) U.S. Cl.

CPC .......... *A61K 9/1272* (2013.01); *A61K 38/164* (2013.01); *A61K 38/45* (2013.01); *A61K 38/465* (2013.01); *A61K 47/549* (2017.08); *A61K 48/00* (2013.01)

(58) Field of Classification Search

CPC .... A61K 38/164; A61K 38/45; A61K 38/465; A61K 47/549; A61K 9/127; C07K 14/00; C07K 2319/09; C12N 15/87; C12N 15/88; C12N 2320/32

See application file for complete search history.

(56) References Cited

U.S. PATENT DOCUMENTS

| | | | |
|---|---|---|---|
| 4,623,620 | A | 11/1986 | Roos et al. |
| 4,623,629 | A | 11/1986 | Kerschensteiner |
| 5,282,785 | A | 2/1994 | Shapland et al. |
| 6,099,857 | A | 8/2000 | Gross |
| 6,120,797 | A | 9/2000 | Meers et al. |
| 6,276,394 | B1 | 8/2001 | Smith et al. |
| 6,416,997 | B1 | 7/2002 | Mir-Shekari et al. |
| 6,790,641 | B2 | 9/2004 | Schauber et al. |
| 6,896,881 | B1 | 5/2005 | Russell et al. |
| 7,094,398 | B1 | 8/2006 | Lieber et al. |
| 7,329,807 | B2 | 2/2008 | Vadrucci et al. |
| 8,697,439 | B2 | 4/2014 | Mangeot et al. |
| 9,050,269 | B2 | 6/2015 | Discher et al. |
| 9,486,539 | B2 | 11/2016 | Lee et al. |
| 9,695,446 | B2 | 7/2017 | Mangeot et al. |
| 10,040,830 | B2 | 8/2018 | Chatterjee et al. |
| 10,064,958 | B2 | 9/2018 | Lee et al. |
| 10,441,601 | B2 | 10/2019 | Zakharenko |
| 10,624,849 | B2 * | 4/2020 | Leonard et al. |
| 11,185,555 | B2 | 11/2021 | Harrison |
| 11,407,812 | B2 | 8/2022 | Thomas et al. |
| 11,576,872 | B2 | 2/2023 | von Maltzahn et al. |
| 11,603,543 | B2 | 3/2023 | Scholz et al. |
| 11,608,509 | B2 | 3/2023 | Costa Fejoz et al. |
| 2002/0150556 | A1 | 10/2002 | Vile et al. |
| 2003/0072773 | A1 | 4/2003 | Wertz et al. |
| 2003/0077249 | A1 | 4/2003 | Bebbington et al. |
| 2003/0207445 | A1 | 11/2003 | Schauber et al. |
| 2004/0009604 | A1 | 1/2004 | Zhang et al. |

(Continued)

FOREIGN PATENT DOCUMENTS

| | | | |
|---|---|---|---|
| EP | 1 115 879 | A1 | 7/2001 |
| EP | 2615176 | A1 | 7/2013 |

(Continued)

OTHER PUBLICATIONS

Davos et al., Proteins: Structure, Function and Genetics, 2000, vol. 41: pp. 98-107.*

Wristlock et al., Quarterly Reviews of Biophysics, 2003, vol. 36 (3): pp. 307-340.*

Kwiatkowski et al., Biochemistry, 1999, vol. 38:pp. 11643-11650.*

Kisselev L., Structure, 2002, vol. 10: pp. 8-9.*

Goder et al., "Topogenesis of membrane proteins: determinants and dynamics," FEBS Letters (2001) vol. 504, pp. 87-93.

Lech et al., "Antibody neutralization of retargeted measles viruses"., Virology (2014) vol. 0, pp. 237-246.

Bender et al., "Receptor-Targeted Nipah Virus Glycoproteins Improve Cell-Type Selective Gene Delivery and Reveal a Preference for Membrane-Proximal Cell Attachment," PLOS Pathogens (2016) vol. 12, No. 6, e1005641, pp. 1-9.

(Continued)

*Primary Examiner* — Tekchand Saidha

*Assistant Examiner* — Mohammad Y Meah

(74) *Attorney, Agent, or Firm* — K&L Gates LLP

(57) ABSTRACT

Fusosome compositions and methods are described herein.

17 Claims, 11 Drawing Sheets

Specification includes a Sequence Listing.

(56) References Cited

U.S. PATENT DOCUMENTS

| | | | |
|---|---|---|---|
| 2004/0028687 | A1 | 2/2004 | Waelti |
| 2005/0070493 | A1 | 3/2005 | Fawell et al. |
| 2006/0045910 | A1 | 3/2006 | Ehringer |
| 2006/0104950 | A1 | 5/2006 | Okano et al. |
| 2007/0031455 | A1 | 2/2007 | Audonnet |
| 2007/0224176 | A1 | 9/2007 | Brink et al. |
| 2007/0298118 | A1 | 12/2007 | Lotvall et al. |
| 2009/0041724 | A1 | 2/2009 | Jensen |
| 2009/0202622 | A1 | 8/2009 | Fleury et al. |
| 2010/0316570 | A1 | 12/2010 | Discher et al. |
| 2011/0184049 | A1 | 7/2011 | Chuah et al. |
| 2012/0093885 | A1 | 4/2012 | Sahoo et al. |
| 2012/0177574 | A1 | 7/2012 | Gho et al. |
| 2012/0322147 | A1 | 12/2012 | Mangeot et al. |
| 2013/0273549 | A1 | 10/2013 | Sullivan et al. |
| 2013/0337066 | A1 | 12/2013 | Zhang et al. |
| 2014/0079774 | A1 | 3/2014 | Brinker et al. |
| 2014/0242107 | A1 | 8/2014 | Mangeot et al. |
| 2015/0050242 | A1 | 2/2015 | Lee et al. |
| 2015/0216903 | A1 | 8/2015 | Heffner et al. |
| 2015/0246139 | A1 | 9/2015 | Bancel et al. |
| 2015/0290343 | A1 | 10/2015 | Lotvall et al. |
| 2016/0011197 | A1 | 1/2016 | Walfish et al. |
| 2016/0017340 | A1 | 1/2016 | Wu et al. |
| 2016/0137716 | A1 | 5/2016 | El Andaloussi et al. |
| 2016/0168572 | A1 | 6/2016 | Lotvall et al. |
| 2016/0220700 | A1 | 8/2016 | Harrison |
| 2016/0289674 | A1 | 10/2016 | Bancel et al. |
| 2016/0354313 | A1 | 12/2016 | De Beer |
| 2017/0087087 | A1* | 3/2017 | Leonard et al. |
| 2017/0112773 | A1 | 4/2017 | Stachowiak et al. |
| 2017/0130197 | A1 | 5/2017 | Haugwitz et al. |
| 2017/0165348 | A1 | 6/2017 | Cantore et al. |
| 2017/0183686 | A1 | 6/2017 | Khvorova et al. |
| 2017/0189449 | A1 | 7/2017 | Lim |
| 2017/0296677 | A1 | 10/2017 | Lee et al. |
| 2018/0028600 | A1 | 2/2018 | Hong et al. |
| 2018/0028687 | A1 | 2/2018 | Selaru et al. |
| 2018/0312824 | A1 | 11/2018 | Zhang et al. |
| 2018/0318331 | A1 | 11/2018 | Zakharenko |
| 2019/0010210 | A1 | 1/2019 | Thomas et al. |
| 2019/0125898 | A1 | 5/2019 | Lee et al. |
| 2019/0144885 | A1 | 5/2019 | Costa Fejoz et al. |
| 2019/0271006 | A1 | 9/2019 | Nakaishi et al. |
| 2020/0016189 | A1 | 1/2020 | Zakharenko |
| 2020/0060980 | A1 | 2/2020 | von Maltzahn et al. |
| 2020/0109419 | A1 | 4/2020 | Scholz |
| 2020/0261589 | A1 | 8/2020 | Galy et al. |
| 2021/0137839 | A1 | 5/2021 | von Maltzahn et al. |
| 2021/0187018 | A1 | 6/2021 | von Maltzahn et al. |
| 2021/0198698 | A1 | 7/2021 | von Maltzahn et al. |
| 2021/0222197 | A1 | 7/2021 | Cantore et al. |
| 2021/0228627 | A1 | 7/2021 | von Maltzahn et al. |
| 2022/0008557 | A1 | 1/2022 | von Maltzahn et al. |
| 2023/0043255 | A1 | 2/2023 | von Maltzahn et al. |
| 2023/0048166 | A1 | 2/2023 | von Maltzahn et al. |
| 2023/0285591 | A1 | 9/2023 | Lee et al. |
| 2023/0348934 | A1 | 11/2023 | Fejoz et al. |
| 2024/0033227 | A1 | 2/2024 | von Maltzahn et al. |
| 2024/0279685 | A1 | 8/2024 | Lee et al. |

FOREIGN PATENT DOCUMENTS

| | | | |
|---|---|---|---|
| JP | H10313865 | A | 12/1998 |
| JP | 2013-034401 | A | 2/2013 |
| WO | 1994/006920 | A1 | 3/1994 |
| WO | 1995/023846 | A1 | 9/1995 |
| WO | 9532706 | A1 | 12/1995 |
| WO | 1997/004748 | A2 | 2/1997 |
| WO | 2000/009730 | A2 | 2/2000 |
| WO | 2000/017374 | A1 | 3/2000 |
| WO | 2001/075135 | A1 | 10/2001 |
| WO | 2001074861 | A2 | 10/2001 |
| WO | 2002/002765 | A2 | 1/2002 |
| WO | 2002/044206 | A2 | 6/2002 |
| WO | 2004/038029 | A1 | 5/2004 |
| WO | 2006/028786 | A2 | 3/2006 |
| WO | 2006027202 | A1 | 3/2006 |
| WO | 2006/059141 | A2 | 6/2006 |
| WO | 2006/078221 | A1 | 7/2006 |
| WO | 2007/005244 | A1 | 1/2007 |
| WO | 2007000668 | A2 | 1/2007 |
| WO | 2008/037458 | A2 | 4/2008 |
| WO | 2008071959 | A1 | 6/2008 |
| WO | 2008115199 | A2 | 9/2008 |
| WO | 2009130208 | A1 | 10/2009 |
| WO | 2010/053489 | A1 | 5/2010 |
| WO | 2011/011584 | A1 | 1/2011 |
| WO | 2011/024172 | A2 | 3/2011 |
| WO | 2011/058052 | A1 | 5/2011 |
| WO | 2012079000 | A1 | 6/2012 |
| WO | 2012/149376 | A2 | 11/2012 |
| WO | 2012158643 | A1 | 11/2012 |
| WO | 2012/170911 | A2 | 12/2012 |
| WO | 2013040557 | A2 | 3/2013 |
| WO | 2013084000 | A2 | 6/2013 |
| WO | 2013/148327 | A1 | 10/2013 |
| WO | 2014/076137 | A1 | 5/2014 |
| WO | 2014/164553 | A1 | 10/2014 |
| WO | 2015011478 | A1 | 1/2015 |
| WO | 2015/077789 | A2 | 5/2015 |
| WO | 2015/110957 | A2 | 7/2015 |
| WO | 2015/161276 | A2 | 10/2015 |
| WO | 2016/009326 | A1 | 1/2016 |
| WO | 2016/030414 | A1 | 3/2016 |
| WO | 2016/077639 | A2 | 5/2016 |
| WO | 2016/126608 | A1 | 8/2016 |
| WO | 2016/138525 | A1 | 9/2016 |
| WO | 2016183482 | A1 | 11/2016 |
| WO | 2016187349 | A1 | 11/2016 |
| WO | 2016/196350 | A1 | 12/2016 |
| WO | 2017/011519 | A1 | 1/2017 |
| WO | 2017/058753 | A1 | 4/2017 |
| WO | 2017/058850 | A1 | 4/2017 |
| WO | 2017075540 | A1 | 5/2017 |
| WO | 2017095946 | A1 | 6/2017 |
| WO | 2017/161010 | A1 | 9/2017 |
| WO | 2017151717 | A1 | 9/2017 |
| WO | 2017165245 | A2 | 9/2017 |
| WO | 2017/173034 | A1 | 10/2017 |
| WO | 2017/180770 | A1 | 10/2017 |
| WO | 2017/182585 | A1 | 10/2017 |
| WO | 2017173367 | A2 | 10/2017 |
| WO | 2017/211945 | A1 | 12/2017 |
| WO | 2018009923 | A1 | 1/2018 |
| WO | 2018/026953 | A1 | 2/2018 |
| WO | 2018022749 | A1 | 2/2018 |
| WO | 2018/075235 | A1 | 4/2018 |
| WO | 2018/088519 | A1 | 5/2018 |
| WO | 2018/098365 | A2 | 5/2018 |
| WO | 2018/106615 | A2 | 6/2018 |
| WO | 2018/119298 | A1 | 6/2018 |
| WO | 2018/129563 | A1 | 7/2018 |
| WO | 2018/208725 | A1 | 11/2018 |
| WO | 2018208728 | A1 | 11/2018 |
| WO | 2018/232020 | A1 | 12/2018 |
| WO | 2019077149 | A1 | 4/2019 |
| WO | 2019/113512 | A1 | 6/2019 |
| WO | 2019/152692 | A1 | 8/2019 |
| WO | 2019/161281 | A1 | 8/2019 |
| WO | 2019204666 | A1 | 10/2019 |
| WO | 2019/222403 | A2 | 11/2019 |
| WO | 2020/014209 | A1 | 1/2020 |
| WO | 2020/102485 | A1 | 5/2020 |
| WO | 2020/102499 | A2 | 5/2020 |
| WO | 2020/102503 | A2 | 5/2020 |
| WO | 2020/102578 | A1 | 5/2020 |

OTHER PUBLICATIONS

Kozlov et al.,, "Membrane tension and membrane fusion," Curr Opin Struct Biol. (2015) vol. 33, pp. 61-67.

(56) References Cited

OTHER PUBLICATIONS

Winnard et al., "Development of novel chimeric transmembrane proteins for multimodality imaging of cancer cells," Cancer Biol Ther (2007) vol. 6, No. 12, pp. 1889-1899.
Chavez et al., "Highly efficient Cas9-mediated transcriptional programming," Nat Methods. (2015) vol. 12, No. 4, pp. 326-328.
Yasuoka et al., "Needleless intranasal administration of HVJ-E containing allergen attenuates experimental allergic rhinitis," J Mol Med (Berl) (2007) vol. 85, No. 3, pp. 283-292.
Mamrosh et al., "Nuclear receptor LRH-1/NR5A2 is required and targetable for liver endoplasmic reticulum stress resolution," eLife. (2014) vol. 3, e01694, pp. 1-24.
Smith et al., "In situ programming of leukaemia-specific T cells using synthetic DNA nanocarriers," Nature Nanotechnology (2017) vol. 12, pp. 813-820.
Richard et al., "Intracellular curvature-generating proteins in cell-to-cell fusion," Biochem J. (2011) vol. 440, Part 2, pp. 185-193.
Chen et al., "Development of T cells carrying two complementary chimeric antigen receptors against glypican-3 and asialoglycoprotein receptor 1 for the treatment of hepatocellular carcinoma," Cancer Immunol. Immunother. (2017) vol. 66, No. 4, pp. 475-489.
Bi et al., "Control of muscle formation by the fusogenic micropeptide myomizer," Science (2017) vol. 356, No. 6335, pp. 323-327.
Zhang et al., "Engineering CAR-T cells," Biomarker Research (2017) vol. 5, article No. 22, pp. 1-10.
Sha et al., "Chimaeric antigen receptor T-cell therapy for tumour immunotherapy," Biosci Rep (2017) vol. 37, No. 1, BSR20160332, pp. 1-12.
Mangeot et al., "Protein transfer into human cells by VSV-G-induced nanovesicles," Mol Ther. (2011) vol. 19, No. 9, pp. 1656-66.
Drive et al., Cell encapsulation: technical and clinical advances. Trends Pharmacol. Sci. (2015) vol. 36, No. 8, pp. 537-546.
Slinde et al. "On the polydispersity of mitochondria in tissue homogenates and the determination of the average sedimentation coefficients of mixed populations of mitochondria," Anal Biochem, 1978, vol. 90, No. 2, pp. 516-524.
De Oliveira et al., "A CD19/Fc fusion protein for detection of anti-CD19 chimeric antigen receptors," J Transl Med (2013) vol. 11, p. 23.
Croyle et al., "PEGylation of a Vesicular Stomatitis Virus G Pseudotyped Lentivirus Vector Prevents Inactivation in Serum" Journal of Virology (2004) vol. 78, No. 2, pp. 912-921.
Gasteiger et al., "Protein Identification and Analysis Tools on the ExPASy Server," The Proteomics Protocols Handbook (2005) pp. 571-607.
Zhang et al., "The microprotein Minion controls cell fusion and muscle formation," Nature Communications (2017) vol. 3, Article No. 15664, pp. 1-15.
Johnson et al., "The Ebola Virus matrix protein, VP40, requires phosphatidylinositol 4,5-bisphosphate (PI(4,5)P2) for extensive oligomerization at the plasma membrane and viral egress," Scientific Reports (2016) vol. 6, Article No. 19125, pp. 1-14.
Stelzer et al., "Tracing dynamic changes of DNA methylation at single cell resolution," Cell. (2015) vol. 163, No. 1, pp. 218-229.
Liu et al., "Editing DNA Methylation in the Mammalian Genome," Cell. (2016) vol. 167, No. 1, e17, pp. 233-247.
Chang et al., "Juxtacrine interaction of macrophages and bone marrow stromal cells induce interleukin-6 signals and promote cell migration," Bone Research (2015) vol. 3, Article No. 15014, pp.
Herzog et al. (2011). A novel informatics concept for high-throughput shotgun lipidomics based on the molecular fragmentation query language. Genome Biol. vol. 12, No. 1, R8, pp. 1-28.
Katoh et al., "Exploitation of the interaction of measles virus fusogenic envelope proteins with the surface receptor CD46 on human cells for microcell-mediated chromosome transfer," BMC Biotechnology (2010) vol. 10, Article No. 37, pp. 1-11.
Kells et al., "Efficient gene therapy-based method for the delivery of therapeutics to primate cortex". PNAS (2009) No. 106, pp. 2407-2411.
Kneissl et al., "Measles Virus Glycoprotein-Based Lentiviral Targeting Vectors That Avoid Neutralizing Antibodies," PLOS One (2012) vol. 7, No. 10, e46667, 1-8.
Mallilankaraman et al., "Visualization of vascular Ca2+ signaling triggered by paracrine derived ROS," J Vis Exp (2011) vol. 58, 3511.
Quiros et al., New roles for mitochondrial proteases in health, ageing and disease. Nat. Rev. Mol. Cell Biol. (2015) vol. 16, No. 6, pp. 345-359.
Smith et al., "Viral entry mechanisms: the increasing diversity of paramyxovirus entry," FEBS J. (2009) vol. 276, No. 24, pp. 7217-7227.
Zhang et al., "Cell-specific targeting of lentiviral vectors mediated by fusion proteins derived from Sindbis virus, vesicular stomatitis virus, or avian sarcoma/leukosis virus," Retrovirology. (2010) vol. 7, p. 3.
Wittings et al., "Characterization of a third generation lentiviral vector pseudotyped with Nipah virus envelope proteins for endothelial cell transduction." Gene therapy (2013) vol. 20, No. 10, pp. 997-1005.
White et al., "Structures and mechanisms of viral membrane fusion proteins: multiple variations on a common theme," Crit Rev Biochem Mol Biol. (2008) vol. 43, No. 3, pp. 189-219.
Weiss et al., "Review, The blood-brain barrier in brain homeostasis and neurological diseases" Biochimica et Biophysica Acta (2009) vol. 1788, pp. 841-857.
Sun, W., "Henipavirus Assembly And Budding," Doctoral Dissertation (online). Pennsylvania 4-6, 7/4-6, 8/4-6 State University. 2015 [retrieved on Sep. 30, 2021]. Retrieved from the Internet: [URL:https://etda.libraries.psu.edu/files/final_submissions/10659]; abstract.
Sugimoto et al., "A novel human endogenous retroviral protein inhibits cell-cell fusion," Sci Rep (2013) vol. 3, p. 1462.
Steffen et al., "Henipavirus mediated membrane fusion, virus entry and targeted therapeutics," Viruses (2012) vol. 4, pp. 280-309.
Sosale et al., "Marker of self: CD47 on lentiviral vectors decreases macrophage-mediated clearance and increases delivery to SIRPA-expressing lung carcinoma tumors." Molecular Therapy (2016) vol. 3, No. 7, p. 16080.
Riazifar et al., "Stem Cell Extracellular Vesicles: Extended Messages of Regeneration," Annu Rev Pharmacol Toxicol. (2017) vol. 57, pp. 125-154.
Plemper et al., "Structural and mechanistic studies of measles virus illuminate paramyxovirus entry," PLoS Pathog. (2011) vol. 7, No. 6, e1002058, pp. 1-6.
Pichard et al., "Specific Micro-RNA regulated TetR-KRAB Transcriptional control of transgene expression in viral vector transduced cells," PLOS ONE (2012) vol. 7, No. 12, e51952, pp. 1-10.
Pager et al., "A mature and fusogenic form of the Nipah virus fusion protein requires proteolytic processing by cathepsin L," Virology. (2006) vol. 346, No. 2, pp. 251-257.
Nordlund et al.,"SNARE-fusion mediated insertion of membrane proteins into native and artificial membranes." Nature Communications (2014) vol. 5, No. 1, pp. 1-8.
Negrete et al., "Single Amino Acid Changes in the Nipah and Hendra Virus Attachment Glycoproteins Distinguish EphrinB2 from EphrinB3 Usage," J Virol (2007) vol. 81, No. 19, pp. 10804-10814.
Nakamura et al., "Antibody-targeted cell fusion," Nat. Biotechnol. (2004) vol. 22, No. 3, pp. 331-336.
Morizono et al., "Redirecting lentiviral vectors pseudotyped with sinbis virus-derived envelope proteins to DC-SIGN by modificiation of N-linked glycans of envelope proteins" J Virol. (2010) vol. 84, No. 14, pp. 6923-6934.
Moll et al., "Importance of the cytoplasmic tails of the measles virus glycoproteins for fusogenic activity and the generation of recombinant measles viruses," J Virol. (2002) vol. 76, No. 14, pp. 7174-7186.
Milani et al., "Phagocytosis-shielded lentiviral vectors improve liver gene therapy in nonhuman primates," Sci Transl Med. (2019) vol. 11, No. 493, eaav7325, pp. 1-14.
Geng et al. "Microfluidic Electroporation for Cellular Analysis and Delivery" Lab Chip (2013) vol. 13, No. 19, pp. 3803-3821.

(56) References Cited

OTHER PUBLICATIONS

Didiot et al., "Exosome-mediated Delivery of Hydrophobically Modified siRNA for Huntingtin mRNA Silencing" Molecular Therapy (2016) vol. 24, No. 10, pp. 1836-1847.
Crop et al. "Human Mesenchymal Stem Cells Are Susceptible to Lysis by CD8+ T Cells and NK Cells" Cell Transplantation (2011) vol. 20, pp. 1547-1559.
Chen et al. "Sustained high level transgene expression in mammalian cells mediated by the optimized piggyBac transposon system" Genes Dis. (2015) vol. 2, No. 1, pp. 96-105.
Bayona-Bafaluy et al., "A chemical enucleation method for the transfer of mitochondrial DNA to ?° cells" Nucleic Acids Res. (2003) vol. 31, No. 16, e98, pp. 1-4.
Chiriaco et al., "Dual-regulated Lentiviral Vector for Gene Therapy of X-linked Chronic Granulomatosis," Molecular Therapy (2014) vol. 22, No. 8, pp. 1472-1483.
Tang et al., "Therapeutic potential of CAR-T cell-derived exosomes: a cell-free modality for targeted cancer therapy," Oncotarget (2015) vol. 6, No. 42, pp. 44179-44190.
International Search Report and Written Opinion issued in PCT/US2019/018324, mailed Jul. 17, 2019.
Spuch et al (2011). Liposomes for Targeted Delivery of Active Agents against Neurodegenerative Diseases (Alzheimer's Disease and Parkinson's Disease). J. Drug Deliv. doi:10.1155/2011/469679.
Calvo et al. (2015). MitoCarta2.0: an updated inventory of mammalian mitochondrial proteins. Nucleic Acids Res. vol. 44, No. D1, pp. D1251-D1257.
International Search Report and Written Opinion for International Application No. PCT/US2019/061535 dated Feb. 21, 2020.
Agrawal et al., "Complement Evasion Strategies of Viruses: An Overview," Front Microbiol. Jun. 16, 2017;8:1117.
Akbulut, H. et al., Gene Therapy—Principles and Challenges, Hashad D. (Ed.), London, United Kingdom, IntechOpen, Nov. 26, 2015 Chapter 1: Cancer Gene Therapy: Section 6.3, 36 pp. https://www.intechopen.com/books/4754 doi: 10.5772/59824.
Ali et al., "Virosome: AN engineered virus for vaccine delivery," Saudi Pharmaceuticals Journal (2023), vol. 31, p. 752-764.
Bagai et al., "Targeted Delivery of Hygromycin B Using Reconstituted Sendai Viral Envelopes Lacking Hemagglutinin-neuraminidase," FEBS (1993), vol. 277, p. 183-188.
Batrakova et al., "Using exosomes, naturally-equipped nanocarriers, for drug delivery," J Control Release (2015) 219:396-405.
Carter et al., "Versatile in vivo genome editing with the prototypical *Streptococcus thermophilus* CRISPR1-Cas9 system," BioRxiv. (2018); 10 pages.
Cattaneo, "Paramyxovirus entry and targeted vectors for cancer therapy," PLoS Pathog. (2010) 6(6):e1000973.
Conner "Mouse Embryo Fibroblast (MEF) Feeder Cell Preparation" Current Protocols in Molecular Biology (2001) 12 VOL, 7 pages.
David et al., "Viral Vectors: The Road to Reducing Genotoxicity," Toxicol Sci. (2017) 155(2):315-325.
Dudu et al., "Sendai virus-based liposomes enable targeted cytosolic delivery of nanoparticles in brain tumor-derived cells," J Nanobiotechnology. (2012) 10:9.
Escors et al., "Cell and Tissue Gene Targeting with Lentiviral Vectors," Lentiviral Vectors and Gene Therapy. (2012) 29-50.
Fang et al., "Cell membrane-derived nanomaterials for biomedical applications," Biomaterials. (2017) 128: 69-83.
Felt et al., "Recent Advances in Vesicular Stomatitis Virus-Based Oncolytuc Virotherapy: a 5-year Update," Journal of General Virology (2017), vol. 98, p. 2895-2911.
Galimi et al., "Development of Ecdysone-Regulated Lentiviral Vectors," Molecular Therapy (2005) 11(1):142-148.
Greenberg et al., "Targeted transgene expression in muller glia of normal and diseased retinas using lentiviral vectors," IOVS (2007) 48(4):1844-1852.
Hafid et al., "Phenylketonuria: a review of current and future treatments," Transl Pediatr. (2015) (4):304-17.
Juzenas et al., "A comprehensive, cell specific microRNA catalogue of human peripheral blood," Nucleic Acids Research (2017), vol. 45 (16), p. 9290-9301.
Lam et al., "Efficient and Safe Herpes Simplex Virus Type 1 Amplicon Vector for Transpictionally Targeted Therapy for Human Hepatocellular Carcinomas," The American Society of Gene Therapy (2007), vol. 15, No. 6, p. 1129-1136.
Lee et al., "Efficient gene transfer of VSV-G pseudotyped retroviral vector to human brain tumor," Gene Ther. (2001) 8 (4):268-73.
Levy et al., "Surface engineering of lentiviral vectors for gene transfer into gene therapy target cells," Current Opinion in Pharmacology (2015) 24:79-85.
Li, "Enhancing HSP70-ShRNA Transfection in 22RV1 Prostate Cancer Cells by Combination of Sonoporation, Liposomes and HTERTA-CMV Chimeric Promoter," International Journal of Oncology (2013), vol. 43, p. 151-158.
LibreTexts. "4.4: Studying Cells—Cell Size." https://bio.libretexts.org/@go/page/12711 accessed Mar. 15, 2023, 2 pages.
Miao et al., "Inclusion of the hepatic locus control region, an intron, and untranslated region increases and stabilizes hepatic factor IX gene expression in vivo but not in vitro," Mol Ther. (2000) 1(6):522-32.
Munch et al., "Off-target-free gene delivery by affinity-purified receptor-targeted viral vectors," Nature Ocmmunications (2015) 6:6246.
Nakamura et al., "Oncolytic Measles Viruses for Cancer Therapy," Expert Opinion on Biological Therapy (2004), vol. 4, No. 10, p. 1685-1692.
Organism—Wikipedia. Retrieved on Sep. 14, 2023. 7 pages.
Rosner et al. (2013). Merging high-quality biochemical fractionation with a refined flow cytometry approach to monitor nucleocytoplasmic protein expression throughout the unperturbed mammalian cell cycle. Nature Protocols 8:602-626.
Salic et al., "A chemical method for fast and sensitive detection of DNA synthesis in vivo," PNAS (2008)105 (7):2415-2420.
Sapir et al., "Viral and Developmental Cell Fusion Mechanisms: Conservation and Divergence," Developmental Cell. (2008) 14(1): 11-21.
Schneider et al., "A Tandem CD19/CD20 Lentiviral Vector Drives On-Target and Off-Target Antigen Modulation in Leukemia Cell Lines," Journal of Immunotherapy (2017), vol. 98, p. 2895-2911.
Sezgin et al., "Elucidating membrane structure and protein behavior using giant plasma membrane vesicles," Nat Protoc (2012) 7(6):1042-1051.
Shim et al., "Efficient and Targeted Delivery of siRNA in Vivo," FEBS (2010), vol. 277, p. 4814-4827.
Suvanasuthi et al., "Rapid transport of plasmid DNA into the nucleolus via actin depolymerization using the HVJ envelope vector," J Gene Med. (2007) 9(1):55-62.
Tan et al., "Cell or cell membrane-based drug delivery systems," Theranostics. (2015) 5(8): 863-81.
ThermoFisher Scientific, RIPA Lysis and Extraction Buffer, Catalog No. 89900, 8 pages, retrieved from www.thermofisher.com/order/catalog/product/89900 (2023).
Ui-Tei et al. (2000) Sensitive assay of RNA interference in Drosophila and Chinese hamster cultured cells using firefly uciferase gene as target. FEBS Letters 479: 79-82.
Van Besouw et al., "Donor-specific T-cell reactivity identifies kidney transplant patients in whom immunosuppressive therapy can be safely reduced," Transplantation (2000) 70(1):136-143.
Wu et al., "Combinatorial control of suicide gene expression by tissue-specific promoter and microRNA regulation for cancer therapy," Mol Ther. Dec. 2009;17(12):2058-66.
Xu et al., "Host cell recognition by the henipaviruses: Crystal structures of the Nipah G attachment glycoprotein and its complex with ephrin-B3," PNAS (2008) 105(29):9953-9958.
Xu et al., "New Insights into the Hendra Virus Attachment and Entry Process from Structures of the Virus G Glycoprotein and Its Complex with Ephrin-B2," PLOS One (2012) 7(11):e48742.
Zernecke et al., "Delivery of microRNA-126 by apoptotic bodies induces CXCL12-dependent vascular protection," Sci Signal. (2009) 2(100): ra81.

(56) References Cited

OTHER PUBLICATIONS

Zhou et al., "Cell type specific gene delivery by lentiviral vectors," Oncolmmunolgy (2013) 2:e22566, Nov. 13, 2024.
Montagna et al., "VSV-G-Enveloped Vesicles for Traceless Delivery of CRISPR-Cas9," Molecular Therapy: Nucleic Acids (2018) vol. 12, pp. 453-462.
Lentz et al. "Review, viral vectors for gene delivery to the central nervous system" Neurobiology of Disease (2012) vol. 48, pp. 179-188.
Lee et al., "Modes of paramyxovirus fusion: a Henipavirus perspective," Trends in Microbiology (2011) vol. 19, No. 8, pp. 389-399.
Leavitt et al., "Concordant modulation of neutrilization resistance and high infectivity of the primary human Immunodeficiency virus type 1 MN strain and definition of a potential gp41 binding site in gp120". Journal of Virology (2003) pp. 560-570.
Kanada et al., "Differential fates of biomolecules delivered to target cells via extracellular vesicles," Proc Natl Acad Sci USA (2015) vol. 112, E1433-E1442, pp. 1-10.
Green et al. Metabolic, enzymatic, and transporter responses in human muscle during three consecutive days of exercise and recovery. Am J Physiol Regul Integr Comp Physiol (2008) vol. 295, No. 4, R12380-R12350, pp. 1-13.
Field et al., "Comparison of lentiviral and sleeping beauty mediated alpha&bgr T cell receptor gene transfer." PLOS ONE (2013) vol. 8, No. 6, e68201, pp. 1-9.
Biering et al. "N-glycans on the nipah virus attachment glycoprotein modulate fusion and viral entry as they protect against antibody neutrilization" Journal of Virology (2012) pp. 11991-12002.
Bender et al., "Developing an Engineered Nipah Virus Glycoprotein Based Lentiviral Vector System Retargeted To Cell Surface Receptors of Choice," Mol. Ther. (2015) vol. 23, No. 1, S2.
Barile et al., "Exosomes: Therapy delivery tools and biomarkers of diseases" Pharmacol Ther (2017) vol. 174, pp. 63-78.
Anliker et al., "Specific gene transfer to neurons, endothelial cells and hematopoietic progenitors with lentiviral vectors," Nat Methods. (2010) vol. 7, No. 11, pp. 929-935.
Zhou et al., "T-cell receptor gene transfer exclusively to human CD8+ cells enhances tumor cell killing," Blood (2012) vol. 120, No. 22, pp. 4334-4342.
Zakaria et al., "Combination of hepatocyte specific delivery and transformation dependent expression of shRNA inducing transcriptional gene silencing of c-Myc promoter in hepatocellular carcinoma cells", Bmc Cancer, Biomed Central, London (2014) vol. 14, No. 1, pp. 582.
Verhoeyen et al., "IL-7 surface-engineered lentiviral vectors promote survival and efficient gene transfer in resting primary T lymphocytes," Blood (2013) vol. 101, No. 6, pp. 2167-2174.
Top et al., "Liposome reconstitution of a minimal protein?mediated membrane fusion machine, " EMBO J (2005) vol. 24, pp. 2980-2988.
Tomas et al., "Improved GaLV-TR glycoproteins to pseudotype lentiviral vectors: impact of viral protease activity in the production of LV pseudotypes." Molecular Therapy (2019) vol. 15, pp. 1-8.
Schauber-Plewa et al., "Complement regulatory proteins are incorporated into lentiviral vectors and protect particles against complement inactivation." Gene Therapy. (2004) vol. 12, No. 3, pp. 238-245.
Podbilewicz, "Virus and cell fusion mechanisms," Annu Rev Cell Dev Biol (2014) vol. 30, pp. 111-139.
Palomares et al., "Nipah virus envelope-pseudotyped lentiviruses efficiently target ephrinB2-positive stem cell populations in vitro and bypass the liver sink when administered in vivo," J Virol. (2013) vol. 87, No. 4, pp. 2094-2108.
Negrete et al., "EphrinB2 is the entry receptor for Nipah virus, an emergent deadly paramyxovirus," Nature (2005) vol. 436, No. 7049, pp. 401-405.
Montagna et al., "VSV-G-Enveloped Vesicles for Traceless Delivery of CRISPR-Cas9" Mol Ther Nucleic Acids. (2018) vol. 12, pp. 453-462.
Mitani et al., "In vivo myomaker?mediated heterologous fusion and nuclear reprogramming," FASEB Journal (2017) vol. 31, No. 1, pp. 400-411.
Milani et al., "Genome editing for scalable produciton of alloantigen free lentiviral vectors for in vivo gene therapy." EMBO Molecular Medicine (2017) vol. 9, No. 11, pp. 1558-1573.
Lattanzi et al."A Strategy of antigen incoperation into exosomes: Comparing cross-presentation levels of antigens delivered by engineered exosomes and by lentiviral virus-like particles", Vaccine (2012) vol. 20, No. 50, p. 7229.
Khetawat et a., "A Functional Henipavirus Envelope Glycoprotein Pseudotyped Lentivirus Assay System," Virol. J. (2010) vol. 7, pp. 312.
Imamura et al., "Autonomous growth and increased cytotoxicity of natural killer cells expressing membrane-bound Interleukin-15" Blood (2014) vol. 124, No. 7, pp. 1081-1088.
Haga et al., "Permanent, lowered HLA class I expression using lentivirus vectors with shRNA constructs: averting cytotoxicity by alloreactive T lymphocytes." Transplantation Proceedings (2006) vol. 38, No. 10, pp. 3184-3188.
Girard-Gagnepain et al., "Baboon envelope pseudotyped LVs outperform VSV-G-LVs for gene transfer into early-cytokine-stimulated and resting HSCs," Blood (2014) vol. 124, No. 8, pp. 1221-1231.
Gadok et al., "Connectosomes for Direct Molecular Delivery to the Cellular Cytoplasm," J Am Chem Soc (2016) vol. 138, No. 39, pp. 12833-12840.
Funke et al., "Targeted cell entry of lentiviral vectors," Mol. Ther. (2008) vol. 16, No. 8, pp. 1427-1436.
Frecha et al., "Stable transduction of quiescent T cells without induction of cycle progression by a novel lentiviral vector pseudotyped with measles virus glycoproteins," Blood (2008) vol. 112, No. 13, pp. 4842-4852.
Enkirch et al., "Targeted lentiviral vectors pseudotyped with the Tupaia paramyxovirus glycoproteins," Gene Ther. (2013) vol. 20, pp. 16-23.
Lin et al "Incorporation of VSV-G produces fusogenic plasma membrane vesicles capable of efficient transfer of bioactive macromolecules and mitochondria" Biomed Microdevices (2016) vol. 18, No. 3, pp. 41.
Martin et al., "Envelope-Targeted Retrovirus Vectors Transduce Melanoma Xenografts but Not Spleen or Liver," Mol Ther (2002) vol. 5, No. 3, pp. 269-274.
Millay et al., "Myomaker is a membrane activator of myoblast fusion and muscle formation," Nature (2013) vol. 499, pp. 301-305.
Munch et al., "DARPins: an efficient targeting domain for lentiviral vectors," Mol Ther. (2011) vol. 19, No. 4, pp. 686-693.
Riedel et al., "Cell surface expression of fusogenic vesicular stomatitis virus G protein from cloned cDNA," EMBO J (1984) vol. 3, No. 7, pp. 1477-1483.
Sanges et al., "Reprogramming Muller glia via in vivo cell fusion regenerates murine photoreceptors," J Clin Invest (2016) vol. 126, No. (8), pp. 3104-3116.
Tanaka et al., "Sendai virus-mediated gene transfer of the c-myc suppressor far-upstream element-binding protein-interacting repressor suppresses head and neck cancer," Gene Therapy (2015) vol. 22, pp. 297-304.
Tsai et al., "Encapsulation of active cytoskeletal protein networks in cell-sized liposomes" Langmuir (2011) vol. 27, No. 16, pp. 10061-10071.
Yang et al., "Virus?Mimetic Fusogenic Exosomes for Direct Delivery of Integral Membrane Proteins to Target Cell Membranes," Advanced Materials (2017) vol. 29, No. 13, pp. 1605604.
Zhou et al., "Exclusive Transduction of Human CD4+ T Cells upon Systemic Delivery of CD4-Targeted Lentiviral Vectors," J Immunol (2015) vol. 19, No. 5, pp. 2493-2501.
Zimmerberg et al., "How proteins produce cellular membrane curvature," Nat Rev Mol Cell Biol (2006) vol. 7, No. 1, pp. 9-19.
Zhang et al., "Measuring energy metabolism in cultured cells, including human pluripotent stem cells and differentiated cells," Nature Protocols (2012) vol. 7, pp. 1068-1085.
Yin et al. (2014). Non-viral vectors for gene-based therapy. Nat. Rev. Genet. vol. 15, No. 8, pp. 541-555.

(56) References Cited

OTHER PUBLICATIONS

Wubbolts et al., "Proteomic and biochemical analyses of human B cell-derived exosomes. Potential implications for their function and multivesicular body formation," J Biol Chem (2003) vol. 278, No. 13, pp. 10963-10972.
Van Besouw et al., "Donor-specific T-cell reactivity identifies kidney transplant patients in whom immunosuppressive therapy can be safely reduced," Transplantation (2000) vol. 70, No. 1, pp. 136-143.
Ji-Tei et al."Sensitive assay of RNA interference in *Drosophila* and Chinese hamster cultured cells using firefly uciferase gene as target" FEBS Letters (2000) vol. 479, pp. 79-82.
Sezgin et al., "Elucidating membrane structure and protein behavior using giant plasma membrane vesicles," Nat Protoc (2012) vol. 7, No. 6, pp. 1042-1051.
Salic et al. "A chemical method for fast and sensitive detection of DNA synthesis in vivo" PNAS (2008) vol. 105, No. 7, pp. 2415-2420.
Rosner et al. "Merging high-quality biochemical fractionation with a refined flow cytometry approach to monitor nucleocytoplasmic protein expression throughout the unperturbed mammalian cell cycle" Nature Protocols (2013) vol. 3, pp. 602-626.
Plant et al., "Notexin causes greater myotoxic damage and slower functional repair in mouse skeletal muscles than bupivacaine," Muscle and Nerve (2006) vol. 34, No. 5, pp. 577-585.
Mitchell et al., "A telomerase component is defective in the human disease dyskeratosis congenita," Nature (1999) vol. 402, No. 6761, pp. 551-555.
Liang et al., Rapid and highly efficiency mammalian cell engineering via Cas9 protein transfection, Journal of Biotechnology (2015) vol. 208, pp. 44-53.
Lee et al., "A comparative study on the efficiency of two enucleation methods in pig somatic cell nuclear transfer: effects of the squeezing and the aspiration methods." Anim Biotechnol. (2008) vol. 19, No. 2, pp. 71-79.
Kupriianov et al., "State of the microcirculatory bed of the mesentery in experimental dehydration," Arkh Anat Gistol Embriol (1979) vol. 77, No. 8, pp. 5-13.
Kavran et al., "Chapter Fourteen—Silver Staining of SDS-polyacrylamide Gel," Methods in Enzymology (2014) vol. 541, pp. 169-176.
Kaneda, "New vector innovation for drug delivery: development of fusigenic non-viral particles," Curr Drug Targets (2003) vol. 4, No. 8, pp. 599-602.
Kamerkar et al., "Exosomes facilitate therapeutic targeting of oncogenic KRAS in pancreatic cancer," Nature (2017) vol. 546, pp. 498-503.
Jao et al., "Exploring RNA transcription and turnover in vivo by using click chemistry," Proc Natl Acad Sci USA (2008) vol. 105, No. 41, pp. 15779-15784.
Gendelman et al., "Monocyte Chemotactic Protein-1 Regulates Voltage-Gated K+ Channels and Macrophage Transmigration," J Neuroimmune Pharmacology (2009) vol. 4, pp. 47-59.
Galic et al., "Coordinated Regulation of Insulin Signaling by the Protein Tyrosine Phosphatases PTP1B and TCPTP," Mol Cel Biol (2005) vol. 25, No. 2, pp. 819-829.
Ellman et al., "A new and rapid colorimetric determination of acetylcholinesterase activity," Biochem Pharma (1961) vol. 7, No. 2, pp. 88-90.
El-Amouri et al., "Secreted Luciferase for In Vivo Evaluation of Systemic Protein Delivery in Mice," Mol Biotechnol (2013) vol. 53, No. 1, pp. 63-73.
Ejsing et al. "Global analysis of the yeast lipidome by quantitative shotgun mass spectrometry" PNAS (2009) vol. 106, No. 7, pp. 2136-2141.
Deleavey et al., "Designing Chemically Modified Oligonucleotides for Targeted Gene Silencing," Chem Biol (2012) vol. 19, No. 8, pp. 937-954.
Alfonzo et al. "Mitochondrial tRNA import-the challenge to understand has just begun" Biol. Chem. (2009) vol. 390, No. 8, pp. 717-722.
Sampaio et al., Membrane lipidome of an epithelial cell line. PNAS (2011) vol. 108, No. 5, pp. 1903-1907.
Zhang et al., "Engineering CAR-T cells," Biomarker Research (2017) 5 article No. 22.
Zhang et al., "The microprotein Minion controls cell fusion and muscle formation," Nature Communications (2017) 8: Article No. 15664.
Vlieghe et al. "Synthetic therapeutic peptides: science and market." Drug Discov. Today (2010) vol. 15, pp. 40-56.
Wen et al., "Anomalous correlation effects and unique phase diagram of electron-doped FeSe revealed by photoemission spectroscopy," Nature Communications (2016) vol. 7, article No. 10840.
Weber-Lolfi et al. "DNA import competence and mitochondrial genetics" Biopolymers and Cell. (2014) vol. 30, No. 1, pp. 71-73.
Vybrant Phagocytosis Assay Kit, Revised Mar. 18, 2001. Molecular Probes. MP 06694.
Thery et al. "Isolation and characterization of exosomes from cell culture supernatants and biological fluids," Curr Protoc Cell Biol (2006) Chapter 3:Unit 3.22.
Surma et al. "An automated shotgun lipidomics platform for high throughput, comprehensive, and quantitative analysis of blood plasma intact lipids" Eur J lipid Sci Technol. (2015) vol. 117, No. 10, pp. 1540-1549.
Sharei et al. "A vector-free microfluidic platform for intracellular delivery" PNAS (2013) vol. 110, No. 6, pp. 2082-2087.
Sha et al., "Chimaeric antigen receptor T-cell therapy for tumour immunotherapy," Biosci Rep (2017) 37(1): BSR20160332.
Quinn et al., "Myomerger induces fusion of non-fusogenic cells and is required for myoblast fusion," Nature Communications (2017) vol. 8, Article No. 15665, pp. 1-9.
Nesbitt et al., "Targeted Intracellular Therapeutic Delivery Using Liposomes Formulated with Multifunctional FAST proteins," (2012). Electronic Thesis and Dissertation Repository. 388. https://ir.lib.uwo.ca/etd/388.
Lavillette et al., "The Envelope Glycoprotein of Human Endogenous Retrovirus Type W Uses a Divergent Family of Amino Acid Transporters/Cell Surface Receptors," J Virol (2002) 76(13):6442-6452.
Jeon et al., "In Vitro Model of Tumor Cell Extravasation," PLOS One (2013) 8(2):e56910.
Croyle et al., "PEGylation of a Vesicular Stomatitis Virus G Pseudotyped Lentivirus Vector Prevents Inactivation in Serum," J Virol (2004) 78(2):912-921.
Chen et al., "Real-time quantification of microRNAs by stem-loop RT-PCR," Nucleic Acids Res (2005) vol. 33, No. 20, e179, pp. 1-9.
Bratosin et al., "Novel fluorescence assay using calcein-AM for the determination of human erythrocyte viability and aging," Cytometry A. (2005) vol. 66, No. 1, pp. 78-84.
Bouma et al. "Determination of cytotoxic T-lymphocyte precursor frequencies using europium labeling as a honradioactive alternative to labeling with chromium-51" Hum. Immunol. (1992) vol. 35 No. 2, pp. 85-92.
Blazar et al., "Strategies to inhibit alloantibody production in alloprimed murine recipients of hematopoietic stem cell grafts," Am J Transplant (2015) vol. 15, No. 4, pp. 931-941.
Benediktsson et al., "Ballistic labeling and dynamic imaging of astrocytes in organotypic hippocampal slice cultures," J Neurosci Methods (2005) vol. 141, No. 1, pp. 41-53.
Alvarez-Erviti et al., "Delivery of siRNA to the mouse brain by systemic injection of targeted exosomes." Nature Biotechnology (2011) vol. 29, No. 4, pp. 341-345.
Alam et al., "Coexpression of EphB4 and ephrinB2 in tumor advancement of uterine cervical cancers," Gynecologic Oncology (2009) vol. 114, No. 1, pp. 84-88.
Aguilar et al., "N-Glycans on Nipah Virus Fusion Protein Protect against Neutralization but Reduce Membrane Fusion and Viral Entry," J Virol (2006) vol. 80, No. 10, pp. 4878-4889.
Aguilar et al., "Polybasic KKR Motif in the Cytoplasmic Tail of Nipah Virus Fusion Protein Modulates Membrane Fusion by Inside-Out Signaling," J Virol (2007) vol. 81, No. 9, pp. 4520-4532.
Abengozar et al., "Blocking ephrinB2 with highly specific antibodies inhibits angiogenesis, lymphangiogenesis, and tumor growth," Blood (2012) vol. 119, No. 19, pp. 4565-4576.

(56) References Cited

OTHER PUBLICATIONS

Ahmad et al."Miro1 regulated intercellular mitochondrial transport and enhances mesenchymal stem cell rescue efficacy" EMBO Journal (2014) vol. 33, No. 9, pp. 994-1010.
Herzog et al., "LipidXplorer: a software for consensual cross-platform lipidomics," PLoS One. (2012) 7(1):e29851.
Soubannier et al. "A Vesicular Transport Pathway Shuttles Cargo from mitochondria to lysosomes" Current Biology (2012) vol. 22, pp. 135-141.
Augustin et al. "Characterization of peptides released from mitochondria: evidence for constant proteolysis and peptide efflux" J Biol Chem (2005) vol. 280, No. 4, pp. 2691-2699.
Lamichhane et al. "Oncogene Knockdown via Active Loading of Small RNAs into Extracellular Vesicles by Sonication" Cell Mol Bioeng (2016) vol. 9, No. 3, pp. 315-324.
Jeon et al. "In Vitro Model of Tumor Cell Extravasation" PLOS ONE (2013) vol. 8, No. 2, e56910, pp. 1-9.
Jacob et al. "Membrane cell permeabilisation with saponin and multiparametric analysis by flow cytometry" Cytometry (1991) vol. 12, No. 6, pp. 550-558 Nov. 13, 2024.
Herzog et al. "LipidXplorer: A Software for Consensual Cross-Platform Lipidomics" PLOS One (2012) vol. 7, No. 1, e29851, pp. 1-7.
Abe et al., "Enhanced gene transfer with fusogenic liposomes containing vesicular stomatitis virus G glycoprotein," J Virol (1998) vol. 72, No. 7, pp. 6159-6163.
Adlakha-Hutcheon et al., "Controlled destabilization of a liposomal drug delivery system enhances mitoxantrone antitumor activity," Nat Biotechnol (1999) vol. 17, pp. 775-779.
Amendola et al., "Regulated and Multiple miRNA and siRNA Delivery Into Primary Cells by a Lentiviral Platform," Mol Ther (2009) vol. 17, No. 6, pp. 1039-1052.
Blechacz et al., "Measles Virus as An Oncolytic Vector Platform," Current Gene Therapy (2008) vol. 8, pp. 162-175.
Brown et al., "A microRNA-regulated lentiviral vector mediates stable correction of hemophilia B mice," Blood. (2007) 110(13): 4144-4152.
Ezigbo et al., "Hepatocellular carcinoma in a patients with chronic lymphocytic leukaemia involoving the liver," BMJ Case Rep (2014) doi:10.1136/bcr-2014-205634, 3 pages.
Field et al. (Jan. 12, 2017), "Interleukin-2 receptor-alpha proximal promoter hypothylation is associated with multiple sclerosis," Genes and Immunity, 18, 59-66.
Follenzi et al. (2002), "Efficient Gene Delivery and Targeted Expression to Hepatocytes In Vivo by Improved Lentiviral Vectors," Human Gene Therapy, 13(2), 243-260.
Gagnepain, "Evolution of new lentiviral vector pseudotypes for gene transfer into hematopoietic cells," Virology (2014) Thesis. Ecole Normale Superieure de Lyon. English. Retrieved from theses. hal.science/tel-01084864, 393 pages.
Gascon et al., "Dual-promoter lentiviral vectors for constitutive and regulated gene expression in neurons," J Neurosci Methods (2008) vol. 168, pp. 104-112.
Gonzales-Aseguinolaza et al. (Sep. 2010), "Durable Correction of Inherited Metabolic Liver Disorders Requires Preventing Transgene Off-Targeting From Gene Therapy Vectors: The Value of MicroRNAs," Gastroenterology, 139(3), in 4 pages.
Gorelik et al. (Jan. 2002), "Transforming Growth Factor-Beta in T-Cell Biology," Nature Reviews Immunology, 2, 46-53.
Imamura et al., Autonomous growth and increased cytotoxicity of natural killer cells expressing membrane-bound interleukin-15, 124(7) Blood 1081-1088 (Aug. 2014).
Kaur et al. (2014), "CD47 Signaling Regulates the Immunosuppressive Activity of VEGF in T Cells," The Journal of Immunology, 193(8), 3914-3924.
Levy et al., "Measles virus envelope pseudotyped lentiviral vectors transduce quiescent human HSCs at an efficiency without precedent," Blood Advances (2017) vol. 1, No. 23, pp. 2088-2104.
Nomura et al., "Microscopic observations reveal that fusogenic peptides induce liposome shrinkage prior to membrane fusion," PNAS (2004) vol. 101, No. 10, pp. 3420-3425.
Tolmachov et al. Chapter 13: Designing Lentiviral Gene Vectors, Book: Viral Gene Therapy, Jul. 2011.
Transfiguracion et al. (Sep. 18, 2020), "Rapid In-Process Monitoring of Lentiviral Vector Particles by High-Performance Liquid Chromatography.," Molecular Therapy: Methods & Clinicial Development, 18, 803-810.
Valastyan et al. (2010), "miR-31: A crucial overseer of tumor metastasis and other emerging roles," Cell Cycle, 9 (11), 2124-2129.
Verhoeyen et al. (2008), "Production of Lentiviruses Displaying "Early-Acting" Cytokines for Selective Gene Transfer into Hematopoietic Stem Cells," Gene Therapy Protocols, 434(2), 99-112.
Wang et al., "AAV Gene Therapy Corrects OTC Deficiency and Prevents Liver Fibrosis in Aged OTC-Knock Out Heterozygous Mice," Molecular Genetics and Metabolism (Apr. 2017), vol. 120, p. 299-305.

* cited by examiner

*Fraction fusosome delivery:* 0.44 0.00

COMPOSITIONS AND METHODS FOR COMPARTMENT-SPECIFIC CARGO DELIVERY

CROSS-REFERENCE TO RELATED APPLICATIONS

This application is a U.S. National Stage Application under 35 U.S.C. § 371 of International Application No. PCT/US2019/061535, filed Nov. 14, 2019, which claims priority to U.S. provisional applications: 62/767,394 filed Nov. 14, 2018, entitled "COMPOSITIONS AND METHODS FOR COMPARTMENT-SPECIFIC CARGO DELIVERY", the contents of each of which are incorporated by reference in their entirety for all purposes.

INCORPORATION BY REFERENCE OF SEQUENCE LISTING

The present application is being filed along with a Sequence Listing in electronic format. The Sequence Listing is provided as a file entitled V2050-7015US_SL.txt, created Jan. 6, 2022 which is 820,364 bytes in size. The information in the electronic format of the Sequence Listing is incorporated by reference in its entirety.

BACKGROUND

Cell-cell fusion is required in biological processes as diverse as fertilization, development, immune response, and tumorigenesis.

SUMMARY

The present disclosure provides technologies relating to fusosomes and their use to deliver membrane proteins to target cells. In some embodiments, a fusosome comprises a lipid bilayer, a lumen surrounded by the lipid bilayer, a fusogen, and a cargo that includes a membrane protein payload agent, In some embodiments, such cargo may be or comprise a membrane protein itself; in some embodiments, such cargo may be or comprise a nucleic acid that encodes (or is complementary to a nucleic acid that encodes) a membrane protein.

Enumerated Embodiments

Membrane Delivery

1. A fusosome comprising:
   (a) a lipid bilayer comprising a plurality of lipids derived from a source cell;
   (b) a lumen (e.g., comprising cytosol) surrounded by the lipid bilayer;
   (c) a fusogen that is exogenous or overexpressed relative to the source cell, e.g., wherein the fusogen is disposed in the lipid bilayer; and
   (d) a membrane protein payload agent (e.g., which is exogenous or overexpressed relative to the source cell) that comprises or encodes one or more of:
   i) a chimeric antigen receptor;
   ii) an integrin membrane protein payload, e.g., chosen from Table 7;
   iii) an ion channel protein chosen from Table 8;
   iv) a pore forming protein, e.g., chosen from Tables 9 and 10;
   v) a Toll-Like Receptor, e.g., chosen from Table 11;

vi) an interleukin receptor payload, e.g., chosen from Table 12;
   vii) a cell adhesion protein chosen from Tables 13-14;
   viii) a transport protein chosen from Table 17;
   ix) a signal sequence that is heterologous relative to the naturally-occurring membrane protein; or
   x) a signal sequence listed in Table 6;

wherein the fusosome does not comprise a nucleocapsid protein or a viral matrix protein.

2. A fusosome comprising:
   (a) a lipid bilayer comprising a plurality of lipids derived from a source cell;
   (b) a lumen (e.g., comprising cytosol) surrounded by the lipid bilayer;
   (c) a fusogen that is exogenous or overexpressed relative to the source cell, e.g., wherein the fusogen is disposed in the lipid bilayer; and
   (d) a membrane protein payload agent (e.g., which is exogenous or overexpressed relative to the source cell) that comprises or encodes a T cell receptor;

wherein optionally the fusosome does not comprise a nucleocapsid protein or a viral matrix protein.

3. A fusosome comprising:
   (a) a lipid bilayer comprising a plurality of lipids derived from a source cell;
   (b) a lumen (e.g., comprising cytosol) surrounded by the lipid bilayer;
   (c) a fusogen that is exogenous or overexpressed relative to the source cell, e.g., wherein the fusogen is disposed in the lipid bilayer; and
   (d) a membrane protein payload agent that is exogenous or overexpressed relative to the source cell; and wherein one or more of:
   i) the fusosome comprises or is comprised by a cytobiologic;
   ii) the fusogen is present at a copy number, e.g., per fusosome, of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 29;
   iii) the fusosome comprises a therapeutic agent at a copy number, e.g., per fusosome, of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 43;
   iv) the fusosome comprises a lipid wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;
   v) the fusosome comprises a proteomic composition similar to that of the source cell, e.g., using an assay of Example 42;
   vi) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

vii) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, or 10%, of the fusosomes in a population of administered fusosomes are present in the target tissue after 24 hours, e.g., by an assay of Example 87 or 100; or viii) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell.

4. A fusosome comprising:

(a) a lipid bilayer comprising a plurality of lipids derived from a source cell;

(b) a lumen (e.g., comprising cytosol) surrounded by the lipid bilayer;

(c) a fusogen that are exogenous or overexpressed relative to the source cell, e.g., wherein the fusogen is disposed in the lipid bilayer; and (d) a membrane protein payload agent that:

i) comprises DNA that encodes a membrane protein; or ii) comprises RNA, e.g., mRNA, that encodes a membrane protein that is exogenous or overexpressed relative to the source cell, wherein the fusosome does not comprise a nucleocapsid protein or a viral matrix protein.

5. A fusosome comprising:

(a) a lipid bilayer comprising a plurality of lipids derived from a source cell;

(b) a lumen (e.g., comprising cytosol) surrounded by the lipid bilayer;

(c) a non-viral, e.g., mammalian, fusogen that is exogenous or overexpressed relative to the source cell, wherein the mammalian fusogen is not Alzheimer's beta-amyloid peptide or fertilin; and (d) a membrane protein payload agent which is exogenous or overexpressed relative to the source cell, wherein optionally the fusosome does not comprise a nucleocapsid protein or a viral matrix protein.

6. A fusosome comprising:

(a) a lipid bilayer comprising a plurality of lipids derived from a source cell;

(b) a lumen (e.g., comprising cytosol) surrounded by the lipid bilayer;

(c) a fusogen that are exogenous or overexpressed relative to the source cell, e.g., wherein the fusogen is disposed in the lipid bilayer; and (d) a membrane protein payload agent that is exogenous or overexpressed relative to the source cell;

wherein the fusosome comprises an enucleated cell, and wherein optionally the fusosome does not comprise a nucleocapsid protein or a viral matrix protein.

7. A fusosome comprising:

(a) a lipid bilayer comprising a plurality of lipids derived from a source cell;

(b) a lumen (e.g., comprising cytosol) surrounded by the lipid bilayer;

(c) a fusogen that are exogenous or overexpressed relative to the source cell, e.g., wherein the fusogen is disposed in the lipid bilayer; and (d) a membrane protein payload agent that is exogenous or overexpressed relative to the source cell;

and wherein one or more of:

i) the fusosome comprises or is comprised by a cytobiologic;

ii) the fusosome comprises an enucleated cell;

iii) the fusosome comprises an inactivated nucleus;

iv) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, e.g., in an assay of Example 54;

v) the fusosome fuses at a higher rate with a target cell than non-target fusosomes, e.g., by at least 10%, 20%, 30%, 40%, 50%, 60%, 70%, 80%, or 90%, e.g., in an assay of Example 54;

vi) the fusosome fuses with target cells at a rate such that the membrane protein payload agent in the fusosome is delivered to at least 10%, 20%, 30%, 40%, 50%, 60%, 70%, 80%, or 90%, of target cells after 24, 48, or 72 hours, e.g., in an assay of Example 54;

vii) the fusogen is present at a copy number, per fusosome, of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 29;

viii) the fusosome comprises the membrane protein payload agent at a copy number, per fusosome, of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 43;

ix) the ratio of the copy number of the fusogen to the copy number of the membrane protein payload agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

x) the fusosome comprises a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, 50%, 55%, 60%, 65%, 70%, or 75% of the corresponding lipid level in the source cell;

xi) the fusosome comprises a proteomic composition similar to that of the source cell, e.g., using an assay of Example 42;

xii) the fusosome comprises a ratio of lipids to proteins that is within 10%, 20%, 30%, 40%, or 50% of the corresponding ratio in the source cell, e.g., as measured using an assay of Example 49;

xiii) the fusosome comprises a ratio of proteins to nucleic acids (e.g., DNA) that is within 10%, 20%, 30%, 40%, or 50% of the corresponding ratio in the source cell, e.g., as measured using an assay of Example 50;

xiv) the fusosome comprises a ratio of lipids to nucleic acids (e.g., DNA) that is within 10%, 20%, 30%, 40%, or 50% of the corresponding ratio in the source cell, e.g., as measured using an assay of Example 51;

xv) the fusosome has a half-life in a subject, e.g., in a mouse, that is within 1%, 2%, 3%, 4%, 5%, 10%, 20%, 30%, 40%, 50%, 60%, 70%, 80%, 90%, 100% of the half life of a reference cell, e.g., the source cell, e.g., by an assay of Example 75;

xvi) the fusosome transports glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of glucose, e.g., as measured using an assay of Example 64;

xvii) the fusosome comprises esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 66;

xviii) the fusosome comprises a metabolic activity (e.g., citrate synthase activity) level that is within 1%, 2%, 3%, 4%, 5%, 10%, 20%, 30%, 40%, 50%, 60%, 70%, 80%, 90%, or 100% of the metabolic activity (e.g., citrate synthase activity) in a reference cell, e.g., the source cell, e.g., as described in Example 68;

xix) the fusosome comprises a respiration level (e.g., oxygen consumption rate) that is within 1%, 2%, 3%, 4%, 5%, 10%, 20%, 30%, 40%, 50%, 60%, 70%, 80%, 90%, or 100% of the respiration level (e.g., oxygen consumption rate) in a reference cell, e.g., the source cell, e.g., as described in Example 69;

xx) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70, xxi) the fusosome has a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 39;

xxii) the fusosome has a soluble:non-soluble protein ratio that is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 47;

xxiii) the fusosome has an LPS level less than 5%, 1%, 0.5%, 0.01%, 0.005%, 0.0001%, 0.00001% or less of the LPS content of the source cell, e.g., as measured by mass spectrometry as described in Example 48;

xxiv) the fusosome and/or compositions or preparations thereof, are capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 63;

xxv) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mammal, e.g., an experimental mammal (e.g., a mouse), a domesticated animal (e.g., a pet or farm animal), or a human, wherein at least 0.1%, 0.5%, 1%, 1.5%, 2%, 2.5%, 3%, 4%, 5%, 10%, 20%, 30%, 40%, 50%, 60%, 70%, 80%, or 90% of the fusosomes in a population of administered fusosomes are present in the target tissue after 24, 48, or 72 hours, e.g., by an assay of Example 87 or 100;

xxvi) the fusosome has juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 71;

xxvii) the fusosome has paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 72;

xxviii) the fusosome polymerizes actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 73;

xxix) the fusosome has a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 74, or wherein the fusosome has a membrane potential of about −20 to −150 mV, −20 to −50 mV, −50 to −100 mV, or −100 to −150 mV;

xxx) the fusosome and/or compositions or preparations thereof, are capable of extravasation from blood vessels, e.g., at a rate at least 1%, 2%, 5%, 10%, 20%, 30%, 40%, 50%, 60%, 70%, 80%, or 90% the rate of extravasation of the source cell, e.g., using an assay of Example 57, e.g., wherein the source cell is a neutrophil, lymphocyte, B cell, macrophage, or NK cell;

xxxi) the fusosome and/or compositions or preparations thereof, are capable of crossing a cell membrane, e.g., an endothelial cell membrane or the blood brain barrier;

xxxii) the fusosome and/or compositions or preparations thereof, are capable of secreting a protein, e.g., at a rate at least 1%, 2%, 3%, 4%, 5%, 10%, 20%, 30%, 40%, 50%, 60%, 70%, 80%, 90%, or 100% greater than reference cell, e.g., a mouse embryonic fibroblast or the source cell, e.g., using an assay of Example 62;

xxxiii) the fusosome meets a pharmaceutical or good manufacturing practices (GMP) standard;

xxxiv) the fusosome was made according to good manufacturing practices (GMP);

xxxv) a pharmaceutical preparation comprising a plurality of fusosomes as described herein has a pathogen level below a predetermined reference value, e.g., is substantially free of pathogens;

xxxvi) a pharmaceutical preparation comprising a plurality of fusosomes as described herein has a contaminant level below a predetermined reference value, e.g., is substantially free of contaminants;

xxxvii) a pharmaceutical preparation comprising a plurality of fusosomes as described herein has low immunogenicity, e.g., as described herein;

xxxviii) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell; or xxxix) the source cell is other than a 293 cell, HEK cell, human endothelial cell, or a human epithelial cell, monocyte, macrophage, dendritic cell, or stem cell.

8. A fusosome comprising:

(a) a lipid bilayer, (b) a lumen (e.g., comprising cytosol) surrounded by the lipid bilayer;

(c) a fusogen that is exogenous or overexpressed relative to the source cell, e.g., wherein the fusogen is disposed in the lipid bilayer, (d) a membrane protein payload agent, e.g., a membrane protein exogenous to the source cell, wherein the fusosome is derived from a source cell; and wherein the fusosome has partial or complete nuclear inactivation (e.g. lacks an intact nucleus as found in the source cell, nuclear removal/enucleation, nonfunctional nucleus, etc.).

9. A fusosome comprising:

(a) a lipid bilayer, (b) a lumen (e.g., comprising cytosol) surrounded by the lipid bilayer;

(c) a fusogen that is exogenous or overexpressed relative to the target cell, e.g., wherein the fusogen is disposed in the lipid bilayer (e.g., wherein the fusogen is endogenous or exogenous to the source cell), and (d) a membrane protein payload agent (e.g., which is exogenous or overexpressed relative to the source cell) that:

i) comprises or encodes a chimeric antigen receptor;

ii) comprises or encodes an integrin membrane protein payload, e.g., chosen from Table 7;

iii) comprises or encodes an ion channel protein chosen from Table 8;

iv) comprises or encodes a pore forming protein, e.g., chosen from Tables 9 and 10;

v) comprises or encodes a Toll-Like Receptor, e.g., chosen from Table 11;

vi) comprises or encodes an interleukin receptor payload, e.g., chosen from Table 12;

vii) comprises or encodes a cell adhesion protein chosen from Tables 13-14;

viii) comprises or encodes a transport protein chosen from Table 17;

ix) comprises or encodes a signal sequence that is heterologous relative to the naturally-occurring membrane protein;

x) comprises or encodes a signal sequence listed in Table 6;

wherein the fusosome does not comprise viral capsid or viral envelope proteins.

10. A fusosome comprising:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer; and (d) a membrane protein payload agent (e.g., which is exogenous or overexpressed relative to the source cell) that comprises or encodes one or more of:

i) a lipid-anchored protein;

ii) an extracellular protein that binds a transmembrane protein;

iii) an extracellular protein that lacks a transmembrane domain;

iv) a protein that partially spans a membrane (e.g., a membrane of the target cell or the fusosome) and does not completely span the membrane (e.g., the protein comprises an in-plane membrane helix, or the protein comprises a hydrophobic loop that does not completely span the membrane); or v) the protein does not comprise a transmembrane domain, wherein the protein interacts with a membrane surface, e.g., through electrostatic or ionic interactions;

wherein the fusosome does not comprise a viral structural protein, e.g., a viral capsid protein or a viral envelope protein.

11. A fusosome comprising:

(a) a lipid bilayer, (b) a lumen (e.g., comprising cytosol) surrounded by the lipid bilayer, (c) a fusogen that is exogenous relative to the source cell or an overexpressed fusogen, e.g., wherein the fusogen is disposed in the lipid bilayer, (d) a membrane protein payload agent, and (e) a functional nucleus, wherein the fusosome is derived from a source cell.

12. The fusosome of any of the preceding embodiments, wherein a plurality of the fusosomes, when contacted with a target cell population in the presence of an inhibitor of endocytosis, and when contacted with a reference target cell population not treated with the inhibitor of endocytosis, delivers the cargo to at least 30%, 40%, 50%, 60%, 70%, or 80% of the number of cells in the target cell population compared to the reference target cell population.

13. The fusosome of any of the preceding embodiments, wherein:
    (i) when the plurality of fusosomes are contacted with a cell population comprising target cells and non-target cells, the cargo is present in at least 2-fold, 5-fold, 10-fold, 20-fold, 50-fold, or 100-fold more target cells than non-target cells, or
    (ii) the fusosomes of the plurality fuse at a higher rate with a target cell than with a non-target cell by at least at least 50%.
14. The fusosome of any of the preceding embodiments, wherein:
    i) the fusogen is present at a copy number of at least 1,000 copies, e.g., as measured by an assay of Example 29; or
    ii) the ratio of the copy number of the fusogen to the copy number of the membrane protein payload agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.
15. The fusosome of any of the preceding embodiments, wherein the fusosome comprises a membrane protein payload agent at a copy number of at least 1,000 copies, e.g., as measured by an assay of Example 43.
16. The fusosome of any of the preceding embodiments, wherein the membrane protein payload agent is a membrane protein, disposed in the fusosome lipid bilayer.
17. The fusosome of any of the preceding embodiments, wherein the membrane protein payload agent is a nucleic acid, disposed in the fusosome lumen, that encodes a membrane protein.
18. The fusosome of embodiment 17, wherein the nucleic acid is or comprises RNA.
19. The fusosome of embodiment 18, wherein the RNA is or comprises a pre-mRNA or an mRNA.
20. The fusosome of embodiment 17, wherein the nucleic acid is or comprises DNA.
21. The fusosome of embodiment 20, wherein the DNA is or comprises a gDNA or a cDNA.
22. The fusosome of any of embodiments 17-21, wherein the nucleic acid further comprises one or more sequences encoding one or more signal sequences, e.g., wherein a target cell translocates a protein comprising a signal sequence to the cell membrane of the target cell.
23. The fusosome of embodiment 22, wherein the one or more signal sequences is or comprise a sequence selected from Table 6.
24. The fusosome of any of embodiments 17-23, wherein the nucleic acid includes one or more regulatory elements that direct expression of sequences encoding the membrane protein by the target cell.
25. The fusosome of any of the preceding embodiments, wherein the membrane protein payload agent is or comprises a sequence of SEQ ID NOs: 8144-16131 of U.S. Patent Publication No. 2016/0289674.
26. The fusosome of any of embodiments 1-24, wherein the membrane protein payload agent is or comprises a fragment, variant, or homolog of a sequence of SEQ ID NOs: 8144-16131 of U.S. Patent Publication No. 2016/0289674.
27. The fusosome of any of embodiments 1-24, wherein the membrane protein payload agent is or comprises a nucleic acid encoding a protein comprising a sequence of SEQ ID NOs: 8144-16131 of U.S. Patent Publication No. 2016/0289674.
28. The fusosome of any of embodiments 1-24, wherein the membrane protein payload agent is or comprises a nucleic acid encoding a protein comprising a fragment, variant, or homolog of a sequence of SEQ ID NOs: 8144-16131 of U.S. Patent Publication No. 2016/0289674.
29. The fusosome of any of embodiments 1-24, wherein the membrane protein payload agent is or comprises a protein selected from Tables 7-17.
30. The fusosome of any of embodiments 1-24, wherein the membrane protein payload agent is or comprises a fragment, variant, or homolog of a protein selected from Tables 7-17.
31. The fusosome of any of embodiments 1-24, wherein the membrane protein payload agent is or comprises a nucleic acid encoding a protein which is or comprises a protein selected from Tables 7-17.
32. The fusosome of any of embodiments 1-24, wherein the membrane protein payload agent is or comprises a nucleic acid encoding a protein comprising a fragment, variant, or homolog of a protein selected from Tables 7-17.
33. The fusosome of any of embodiments 1-24, wherein the membrane protein payload agent is or comprises a chimeric antigen receptor (CAR) comprising an antigen binding domain.
34. The fusosome of embodiment 33, wherein the CAR is or comprises a first generation CAR comprising an antigen binding domain, a transmembrane domain, and signaling domain.
35. The fusosome of embodiment 33, wherein the CAR is or comprises a second generation CAR comprising an antigen binding domain, a transmembrane domain, and two signaling domains.
36. The fusosome of embodiment 33, wherein the CAR is or comprises a third generation CAR comprising an antigen binding domain, a transmembrane domain, and at least three signaling domains.
37. The fusosome of embodiment 33, wherein the CAR is or comprises a fourth generation CAR comprising an antigen binding domain, a transmembrane domain, three or four signaling domains, and a domain which upon successful signaling of the CAR induces expression of a cytokine gene.
38. The fusosome of any of embodiments 33-37, wherein the antigen binding domain is or comprises an scFv or Fab.
39. The fusosome of any of embodiments 33-38, wherein the antigen binding domain targets an antigen characteristic of a neoplastic cell.
40. The fusosome of embodiment 39, wherein the antigen characteristic of a neoplastic cell is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multispan transmembrane protein, T-cell receptor motifs; T-cell alpha chains; T-cell β chains; T-cell γ chains; T-cell δ chains; CCR7; CD3; CD4; CD5; CD7; CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; $T_{RE}G$; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-$\gamma^2$, VEGF, VEGFR 1/2/3, αVβ3, α5β1, ErbB 1/EGFR, ErbB1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-10, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13Rα1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A,B,C) CD49f, CD151 CD340, CD200, tkrA, trkB, or trkC, or an antigenic fragment or antigenic portion thereof.

41. The fusosome of any of embodiments 33-38, wherein the antigen binding domain targets an antigen characteristic of a T-cell.
42. The fusosome of embodiment 41, wherein the antigen characteristic of a T-cell is selected from a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T-cell. In some embodiments, an antigen characteristic of a T-cell may be a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, AKT1; AKT2; AKT3; ATF2; BCL10; CALM1; CD3D (CD3δ); CD3E (CD3ε); CD3G (CD3γ); CD4; CD8; CD28; CD45; CD80 (B7-1); CD86 (B7-2); CD247 (CD3ζ); CTLA4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38(3); MAPK12 (p38γ); MAPK13 (p38δ); MAPK14 (p38α); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.
43. The fusosome of any of embodiments 33-38, wherein the antigen binding domain targets an antigen characteristic of an autoimmune or inflammatory disorder.
44. The fusosome of embodiment 43, wherein the autoimmune or inflammatory disorder is selected from chronic graft-vs-host disease (GVHD), lupus, arthritis, immune complex glomerulonephritis, goodpasture, uveitis, hepatitis, systemic sclerosis or scleroderma, type I diabetes, multiple sclerosis, cold agglutinin disease, Pemphigus vulgaris, Grave's disease, autoimmune hemolytic anemia, Hemophilia A, Primary Sjogren's Syndrome, thrombotic thrombocytopenia purrpura, neuromyelits optica, Evan's syndrome, IgM mediated neuropathy, cyroglobulinemia, dermatomyositis, idiopathic thrombocytopenia, ankylosing spondylitis, bullous pemphigoid, acquired angioedema, chronic urticarial, antiphospholipid demyelinating polyneuropathy, and autoimmune thrombocytopenia or neutropenia or pure red cell aplasias, while exemplary non-limiting examples of alloimmune diseases include allosensitization (see, for example, Blazar et al., 2015, Am. J. Transplant, 15(4):931-41) or xenosensitization from hematopoietic or solid organ transplantation, blood transfusions, pregnancy with fetal allosensitization, neonatal alloimmune thrombocytopenia, hemolytic disease of the newborn, sensitization to foreign antigens such as can occur with replacement of inherited or acquired deficiency disorders treated with enzyme or protein replacement therapy, blood products, and gene therapy.

45. The fusosome of embodiment 43 or embodiment 44, wherein the antigen characteristic of an autoimmune or inflammatory disorder is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor. In some embodiments, a CAR antigen binding domain binds to a ligand expressed on B cells, plasma cells, plasmablasts, CD10, CD19, CD20, CD22, CD24, CD27, CD38, CD45R, CD138, CD319, BCMA, CD28, TNF, interferon receptors, GM-CSF, ZAP-70, LFA-1, CD3 gamma, CD5 or CD2.
46. The fusosome of any of embodiments 33-38, wherein the antigen binding domain targets an antigen characteristic of an infectious disease.
47. The fusosome of embodiment 46, wherein the infectious disease is selected from HIV, hepatitis B virus, hepatitis C virus, Human herpes virus, Human herpes virus 8 (HHV-8, Kaposi sarcoma-associated herpes virus (KSHV)), Human T-lymphotrophic virus-1 (HTLV-1), Merkel cell polyomavirus (MCV), Simian virus 40 (SV40), Epstein-Barr virus, CMV, human papillomavirus.
48. The fusosome of embodiment 46 or embodiment 47, wherein the antigen characteristic of an infectious disease is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, HIV Env, gp120, or CD4-induced epitope on HIV-1 Env.
49. The fusosome of any of embodiments 33-48, wherein the transmembrane domain comprises at least a transmembrane region of the alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, or functional variant thereof.
50. The fusosome of any of embodiments 33-49, wherein the transmembrane domain comprises at least a transmembrane region(s) of CD8α, CD8β, 4-1BB/CD137, CD28, CD34, CD4, FcεRIγ, CD16, OX40/CD134, CD3ζ, CD3ε, CD3γ, CD3δ, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or functional variant thereof.
51. The fusosome of any of embodiments 33-50, wherein the CAR comprises at least one signaling domain selected from one or more of B7-1/CD80; B7-2/CD86; B7-H1/PD-L1; B7-H2; B7-H3; B7-H4; B7-H6; B7-H7; BTLA/CD272; CD28; CTLA-4; Gi24/VISTA/B7-H5; ICOS/CD278; PD-1; PD-L2/B7-DC; PDCD6); 4-1BB/TNFSF9/CD137; 4-1BB Ligand/TNFSF9; BAFF/BLyS/TNFSF13B; BAFF R/TNFRSF13C; CD27/TNFRSF7; CD27 Ligand/TNFSF7; CD30/TNFRSF8; CD30 Ligand/TNFSF8; CD40/TNFRSF5; CD40/TNFSF5; CD40 Ligand/TNFSF5; DR3/TNFRSF25; GITR/TNFRSF18; GITR Ligand/TNFSF18; HVEM/TNFRSF14; LIGHT/TNFSF14; Lymphotoxin-alpha/TNF-beta; OX40/TNFRSF4; OX40 Ligand/TNFSF4; RELT/TNFRSF19L; TACI/TNFRSF13B; TL1A/TNFSF15; TNF-alpha; TNF RII/TNFRSF1B); 2B4/CD244/SLAMF4; BLAME/SLAMF8; CD2; CD2F-10/SLAMF9; CD48/SLAMF2; CD58/LFA-3; CD84/SLAMF5; CD229/SLAMF3; CRACC/SLAMF7; NTB-A/SLAMF6; SLAM/CD150); CD2; CD7; CD53; CD82/Kai-1; CD90/Thy1; CD96; CD160; CD200; CD300a/LMIR1; HLA Class I; HLA-DR; Ikaros; Integrin alpha 4/CD49d; Integrin alpha 4 beta 1; Integrin alpha 4 beta 7/LPAM-1; LAG-3; TCL1A; TCL1B; CRTAM; DAP12; Dectin-1/CLEC7A; DPPIV/CD26; EphB6; TIM-1/KIM-1/HAVCR; TIM-4; TSLP; TSLP R; lymphocyte function associated antigen-1 (LFA-1); NKG2C, a CD3 zeta domain, an immunoreceptor tyrosine-based activation motif (ITAM), CD27, CD28, 4-1BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83, or functional fragment thereof.
52. The fusosome of any of embodiments 33-51, wherein the CAR comprises a CD3 zeta domain or an immunoreceptor tyrosine-based activation motif (ITAM), or functional variant thereof.
53. The fusosome of any of embodiments 33-51, wherein the CAR comprises (i) a CD3 zeta domain, or an immunoreceptor tyrosine-based activation motif (ITAM), or functional variant thereof; and (ii) a CD28 domain, or a 4-1BB domain, or functional variant thereof.
54. The fusosome of any of embodiments 33-51, wherein the CAR comprises a (i) a CD3 zeta domain, or an immunoreceptor tyrosine-based activation motif (ITAM), or functional variant thereof; (ii) a CD28 domain or functional variant thereof; and (iii) a 4-1BB domain, or a CD134 domain, or functional variant thereof.
55. The fusosome of any of embodiments 33-53, wherein the CAR comprises a (i) a CD3 zeta domain, or an immunoreceptor tyrosine-based activation motif (ITAM), or functional variant thereof; (ii) a CD28 domain or functional variant thereof; (iii) a 4-1BB domain, or a CD134 domain, or functional variant thereof; and (iv) a cytokine or costimulatory ligand transgene.
56. The fusosome of any of embodiments 33-53, wherein the CAR further comprises one or more spacers.
57. The fusosome of embodiment 56, wherein the spacer is a first spacer between the antigen binding domain and the transmembrane domain.
58. The fusosome of embodiment 56 or embodiment 57, wherein the first spacer includes at least a portion of an immunoglobulin constant region or variant or modified version thereof.
59. The fusosome of any of embodiments 56-58, wherein the spacer is a second spacer between the transmembrane domain and a signaling domain.
60. The fusosome of embodiment 59, wherein the second spacer is an oligopeptide.
61. The fusosome of embodiment 60, wherein the oligopeptide comprises glycine-serine doublets.
62. The fusosome of embodiment 18-32, wherein the membrane protein is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB 1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multispan transmembrane protein, T-cell receptor motifs; T-cell alpha chains; T-cell β chains; T-cell γ chains; T-cell δ chains; CCR7; CD3; CD4; CD5; CD7; CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; $T_{RE}G$; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-$\gamma^2$, VEGF, VEGFR 1/2/3, αVβ3, α5β1, ErbB 1/EGFR, ErbB 1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-1(3, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13Rα1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A,B,C) CD49f, CD151 CD340, CD200, tkrA, trkB, or trkC.

63. The fusosome of any of the preceding embodiments, wherein the fusosome enters the target cell by endocytosis, e.g., wherein the level of membrane protein payload agent delivered via an endocytic pathway for a given fusosome is 0.01-0.6, 0.01-0.1, 0.1-0.3, or 0.3-0.6, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 91.
64. The fusosome of any of the preceding embodiments, wherein the fusosome enters the target cell by a non-endocytic pathway, e.g., wherein the level of membrane protein payload agent delivered via a non-endocytic pathway for a given fusosome is 0.1-0.95, 0.1-0.2, 0.2-0.3, 0.3-0.4, 0.4-0.5, 0.5-0.6, 0.6-0.7, 0.7-0.8, 0.8-0.9, 0.9-0.95, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 90.
65. The fusosome of any of the preceding embodiments, wherein:
    i) the membrane protein payload agent is a membrane protein, or a nucleic acid (e.g., a DNA, a gDNA, a cDNA, an RNA, a pre-mRNA, an mRNA, etc.) encoding or complementary to one that encodes, a membrane protein, e.g., a chimeric antigen receptor (CAR);
    ii) the membrane protein is or comprises a receptor, such as an antigen receptor, which in some embodiments may be a natural receptor or an engineered receptor e.g., a CAR;
    iii) the membrane protein is or comprises an integrin;
    iv) the membrane protein is or comprises a T cell receptor;
    v) the membrane protein is or comprises a membrane transport protein such as an ion channel protein or a pore-forming protein (e.g., a hemolysin or colicin);
    vi) the membrane protein is or comprises a toll-like receptor;
    vii) the membrane protein is or comprises an interleukin receptor;
    viii) the membrane protein is or comprises a membrane enzyme; or
    ix) the membrane protein is or comprises a cell adhesion protein (e.g., cadherin protein, selectin protein, mucin protein, etc.).
66. The fusosome of any of the preceding embodiments, wherein:
    i) the membrane protein is an integral membrane protein;
    ii) the membrane protein is a peripheral membrane protein;
    iii) the membrane protein is temporarily associated with a membrane;

iv) the membrane protein is a protein that is associated with, and/or wholly or partially spans (e.g., as a transmembrane protein) a target cell's membrane;

v) the membrane protein is an integral monotopic protein (i.e., associated with only one side of a membrane);

vi) the membrane protein is or becomes associated with (e.g., is partly or wholly present on) an outer surface of a target cell's membrane; or vii) the membrane protein is or becomes associated with (e.g., is partly or wholly present on) an inner surface of a target cell's membrane.

67. The fusosome of any of the preceding embodiments, wherein:

i) the membrane protein is a therapeutic membrane protein; or ii) the membrane protein is or comprises a receptor (e.g., a cell surface receptor and/or a transmembrane receptor), a cell surface ligand, a membrane transport protein (e.g., an active or passive transport protein such as, for example, an ion channel protein, a pore-forming protein [e.g., a toxin protein], etc), a membrane enzyme, and/or a cell adhesion protein).

68. The fusosome of any of the preceding embodiments, wherein:

i) the membrane protein comprises a sequence of a naturally-occurring membrane protein;

ii) the membrane protein is or comprises a variant or modified version of a naturally-occurring membrane protein;

iii) the membrane protein is or comprises an engineered membrane protein; or iv) the membrane protein is or comprises a fusion protein.

69. The fusosome of any of the preceding embodiments, wherein the fusosome delivers a membrane protein payload agent to the membrane of a target cell, e.g., as described herein.

70. The fusosome of embodiment 69, wherein the fusosome is further capable of delivering (e.g., delivers) one or more agents, e.g., proteins, nucleic acids (e.g., a DNA, a gDNA, a cDNA, an RNA, a pre-mRNA, an mRNA, etc.), organelles, or and/or metabolites to the cytosol of the target cell.

71. A fusosome composition or preparation, comprising a plurality of fusosomes, wherein at least one fusosome comprises:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer;

(d) a membrane protein payload agent, e.g., as described herein.

72. A frozen purified fusosome composition or preparation comprising a plurality of fusosomes comprising a membrane protein payload agent described herein, wherein the preparation is frozen at a temperature that is at or less than, 4, 0, −4, −10, −12, −16, −20, −80, or −160° C.

73. The fusosome composition of embodiment 71 or embodiment 72, where at least one fusosome of the plurality of fusosomes is derived from a source cell.

74. The fusosome composition of any of embodiments 71-73, wherein the fusosome is at a temperature of less than 4, 0, −4, −10, −12, −16, −20, −80, or −160° C.

75. The fusosome composition of any of embodiments 71-74, wherein the plurality of fusosomes comprises at least about $10^3$, $10^4$, $10^5$, $10^6$, $10^7$, $10^8$, $10^9$, $10^{10}$, $10^{11}$, $10^{12}$, $10^{13}$, $10^{14}$, or $10^{15}$ fusosomes.

76. The fusosome composition of any of embodiments 71-75, wherein the plurality of fusosomes are the same.

77. The fusosome composition of embodiment 76, wherein the plurality of fusosomes are the same if at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of the fusosomes in the fusosome composition share at least one property selected from:

comprise the same fusogen;

produced using the same type of source cell; or comprise the same membrane protein payload agent.

78. The fusosome composition of any of embodiments 71-75, wherein the plurality of fusosomes are different.

79. The fusosome composition of any of embodiments 71-77, wherein the plurality of fusosomes is derived from two or more types of source cells.

80. The fusosome composition of any of embodiments 71-79, which has a volume of at least 1 μL, 2 μL. 5 μL, 10 μL, 20 μL, 50 μL, 100 μL, 200 μL, 500 μL, 1 mL, 2 mL, 5 mL, or 10 mL.

81. The fusosome composition of any of embodiments 71-80, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise a functional nucleus.

82. The fusosome composition of any of embodiments 71-81, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise a nucleus.

83. The fusosome composition of any of embodiments 71-82, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which are substantially free of nuclear DNA.

84. The fusosome composition of any of embodiments 71-83, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise functional mitochondria.

85. The fusosome composition of any of embodiments 71-84, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise mitochondria.

86. The fusosome composition of any of embodiments 71-85, which comprises less than 0.01%, 0.05%, 0.1%, 0.5%, 1%, 1.5%, 2%, 2.5%, 3%, 4%, 5%, or 10% source cells by protein mass or less than 0.01%, 0.05%, 0.1%, 0.5%, 1%, 1.5%, 2%, 2.5%, 3%, 4%, 5%, or 10% of source cells having a functional nucleus.

87. The fusosome composition of any of embodiments 71-86, wherein the fusosome composition comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes wherein:
  i) the fusogen is present at a copy number of at least 1,000 copies per fusosome, e.g., as measured by an assay of Example 29; or
  ii) the ratio of the copy number of the fusogen to the copy number of the membrane protein payload agent per fusosome is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.

88. The fusosome composition of any of embodiments 71-87, wherein the fusosome composition comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes wherein the membrane protein payload agent is present at a copy number of at least 1,000 copies per fusosome, e.g., as measured by an assay of Example 43.

89. The fusosome composition of any of embodiments 71-77, wherein the plurality of fusosomes has a mean diameter of at least about 50 nm, about 80 nm, about 100 nm, about 200 nm, about 500 nm, about 1000 nm, about 1200 nm, about 1400 nm, or about 1500 nm.

90. The fusosome composition of any of embodiments 71-89, wherein the plurality of fusosomes comprises fusosomes having a diameter within the range of about 10 nm to about 100 μm.

91. The fusosome composition of any of embodiments 71-89, wherein the plurality comprises fusosomes having a size within the range of about 20 nm to about 200 nm, about 50 nm to about 200 nm, about 50 nm to about 100 nm, about 50 nm to about 150 nm, or about 100 nm to about 150 nm.

92. The fusosome composition of any of embodiments 71-91, wherein at least 50% of fusosomes in the plurality have a diameter within 10%, 20%, 30%, 40%, or 50% of the mean diameter of the fusosomes in the fusosome composition.

93. The fusosome composition of any of embodiments 71-92, wherein the plurality comprises fusosomes having a volume within the range of about 500 $nm^3$ to about 0.0006 $mm^3$, or about 4,000 $nm^3$ to about 0.005 $\mu m^3$, about 65,000 $nm^3$ to about 0.005 $\mu m^3$, about 65,000 $nm^3$ to about 0.0006 $\mu m^3$, about 65,000 $nm^3$ to about 0.002 $\mu m^3$, or about 0.0006 $\mu m^3$ to about 0.002 $\mu m^3$.

94. The fusosome composition of any of embodiments 71-93, wherein at least 50% of fusosomes in the plurality have a volume within 10%, 20%, 30%, 40%, or 50% of the mean volume of the fusosomes in the fusosome composition.

95. The fusosome composition of any of embodiments 71-94, wherein at least 50% of fusosomes in the plurality have a copy number of the fusogen within 10%, 20%, 30%, 40%, or 50% of the mean fusogen copy number in the fusosomes in the fusosome composition.

96. The fusosome composition of any of embodiments 71-95, wherein at least 50% of fusosomes in the plurality have a copy number of the protein membrane payload within 10%, 20%, 30%, 40%, or 50% of the mean protein membrane payload copy number in the fusosomes in the fusosome composition.

97. The fusosome composition or pharmaceutical composition of any of the preceding embodiments, wherein:
  i) a membrane protein payload agent is partially or wholly disposed in a fusosome lumen;
  ii) a membrane protein payload agent is associated with (e.g., partially or wholly located within) a fusosome's lipid bilayer; or
  i) the relevant membrane protein is associated with and/or partially or wholly displayed on the fusosome's external surface.

98. A method of manufacturing a fusosome composition, comprising:
  a) providing a source cell comprising, e.g., expressing, a fusogen;
  b) producing a fusosome from the source cell, wherein the fusosome comprises a lipid bilayer, a lumen, a fusogen, and a membrane protein payload agent, thereby making a fusosome; and
  c) formulating the fusosome, e.g., as a pharmaceutical composition suitable for administration to a subject, wherein one or more of:
    i) the source cell is other than a 293 cell, HEK cell, human endothelial cell, or a human epithelial cell;
    ii) the fusogen is other than a viral protein;
    iii) the fusosome and/or compositions or preparations thereof has a density of other than between 1.08 g/mL and 1.12 g/mL, e.g.,
    iv) the fusosome and/or compositions or preparations thereof has a density of 1.25 g/mL+/−0.05, e.g., as measured by an assay of Example 33;
    v) the fusosome is not captured by the scavenger system in circulation or by Kupffer cells in the sinus of the liver;
    vi) the fusosome is not captured by the reticuloendothelial system (RES) in a subject, e.g., by an assay of Example 76;
    vii) when a plurality of fusosomes are administered to a subject, less than 1%, 2%, 3%, 4%, 5%, 10%, 20%, 30%, 40%, 50%, 60%, 70%, 80%, 90%, of the plurality are not captured by the RES after 24 hours, e.g., by an assay of Example 76;
    viii) the fusosome has a diameter of greater than 5 μm, 6 μm, 7 μm, 8 μm, 10 μm, 20 μm, 50 μm, 100 μm, 150 μm, or 200 μm.
    ix) the fusosome comprises a cytobiologic;
    x) the fusosome comprises an enucleated cell; or
    xi) the fusosome comprises an inactivated nucleus.

99. The method of embodiment 98, wherein providing a source cell expressing a fusogen comprises expressing an exogenous fusogen in the source cell or upregulating expression of an endogenous fusogen in the source cell.

100. The method of embodiment 98 or embodiment 99, which comprises inactivating the nucleus of the source cell.

101. The method of any of embodiments 98-100, which comprises introducing a membrane protein payload (e.g., a nucleic acid or protein) into a fusosome, e.g., by electroporation.

102. A method of manufacturing a fusosome drug product composition, comprising:

a) providing, e.g., producing, a plurality of fusosomes according to any of embodiments 1-70, a fusosome composition of any of embodiments 71-97, or a pharmaceutical composition of embodiment 97; and b) assaying one or more fusosomes from the plurality to determine whether one or more (e.g., 2, 3, or all) of the following standards are met:

i) the fusosome fuses at a higher rate with a target cell than with a non-target cell, e.g., by at least at least 10% e.g., in an assay of Example 54;

ii) the fusosome fuses at a higher rate with a target cell than with other fusosomes, e.g., by at least 50% e.g., in an assay of Example 54;

iii) the fusosome fuses with target cells at a rate such that an agent in the fusosome is delivered to at least 10% of target cells after 24 hours, e.g., in an assay of Example 54;

iv) the fusogen is present at a copy number of at least 1,000 copies, e.g., as measured by an assay of Example 29;

v) the fusosome comprises a membrane protein payload agent at a copy number of at least 1,000 copies, e.g., as measured by an assay of Example 43;

vi) the ratio of the copy number of the fusogen to the copy number of the membrane protein payload agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

vii) the fusosome comprises a lipid composition wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;

viii) the fusosome comprises a proteomic composition similar to that of the source cell, e.g., using an assay of Example 42;

ix) the fusosome comprises a ratio of lipids to proteins that is within 10%, 20%, 30%, 40%, or 50% of the corresponding ratio in the source cell, e.g., as measured using an assay of Example 49;

x) the fusosome comprises a ratio of proteins to nucleic acids (e.g., DNA) that is within 10%, 20%, 30%, 40%, or 50% of the corresponding ratio in the source cell, e.g., as measured using an assay of Example 50;

xi) the fusosome comprises a ratio of lipids to nucleic acids (e.g., DNA) that is within 10%, 20%, 30%, 40%, or 50% of the corresponding ratio in the source cell, e.g., as measured using an assay of Example 51;

xii) the fusosome has a half-life in a subject, e.g., in a mouse, that is within 90% of the half-life of a reference cell, e.g., the source cell, e.g., by an assay of Example 75; xiii) the fusosome transports glucose (e.g., labeled glucose, e.g., 2-NBDG) across a membrane, e.g., by at least 10% more than a negative control, e.g., an otherwise similar fusosome in the absence of glucose, e.g., as measured using an assay of Example 64;

xiv) the fusosome comprises esterase activity in the lumen that is within 90% of that of the esterase activity in a reference cell, e.g., the source cell or a mouse embryonic fibroblast, e.g., using an assay of Example 66;

xv) the fusosome comprises a metabolic activity level that is within 90% of the metabolic activity (e.g., citrate synthase activity) in a reference cell, e.g., the source cell, e.g., as described in Example 68;

xvi) the fusosome comprises a respiration level (e.g., oxygen consumption rate) that is within 90% of the respiration level in a reference cell, e.g., the source cell, e.g., as described in Example 69;

xvii) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70;

xviii) the fusosome has a miRNA content level of at least 1% than that of the source cell, e.g., by an assay of Example 39;

xix) the fusosome has a soluble:non-soluble protein ratio is within 90% of that of the source cell, e.g., by an assay of Example 47;

xx) the fusosome has an LPS level less than 5% of the lipid content of fusosomes, e.g., as measured by an assay of Example 48;

xxi) the fusosome and/or compositions or preparations thereof, are capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

xxii) the fusosome has juxtacrine-signaling level of at least 5% greater than the level of juxtacrine signaling induced by a reference cell, e.g., the source cell or a bone marrow stromal cell (BMSC), e.g., by an assay of Example 71;

xxiii) the fusosome has paracrine-signaling level of at least 5% greater than the level of paracrine signaling induced by a reference cell, e.g., the source cell or a macrophage, e.g., by an assay of Example 72;

xxiv) the fusosome polymerizes actin at a level within 5% compared to the level of polymerized actin in a reference cell, e.g., the source cell or a C2C12 cell, e.g., by the assay of Example 73;

xxv) the fusosome has a membrane potential within about 5% of the membrane potential of a reference cell, e.g., the source cell or a C2C12 cell, e.g., by an assay of Example 74, or wherein the fusosome has a membrane potential of about −20 to −150 mV, −20 to −50 mV, −50 to −100 mV, or −100 to −150 mV;

xxvi) the fusosome and/or compositions or preparations thereof, are capable of secreting a protein, e.g., at a rate at least 5% greater than a reference cell, e.g., a mouse embryonic fibroblast, e.g., using an assay of Example 62; or xxvii) the fusosome has low immunogenicity, e.g., as described herein; and c) (optionally) approving the plurality of fusosomes or fusosome composition for release if one or more of the standards is met;

thereby manufacturing a fusosome drug product composition.

103. A method of manufacturing a fusosome composition, comprising:

a) providing a source cell comprising, e.g., expressing, a fusogen;

b) producing a fusosome from the source cell, wherein the fusosome comprises a lipid bilayer, a lumen, a fusogen and a membrane protein payload agent, thereby making a fusosome; and c) formulating the fusosome, e.g., as a pharmaceutical composition suitable for administration to a subject.

104. A method of manufacturing a fusosome composition, comprising:

a) providing, e.g., producing, a plurality of fusosomes or a fusosome preparation described herein; and b) assaying a sample of the plurality (e.g., of the preparation) to determine whether one or more (e.g., 2, 3, or more) standards are met.

105. The method of embodiment 104, wherein the standard(s) are chosen from:

i) fusosomes in the sample fuse at a higher rate with a target cell than with a non-target cell, e.g., by at least at least 1%, 2%, 3%, 4%, 5%, 10%, 20%, 30%, 40%, 50%, 60%, 70%, 80%, 90%, e.g., in an assay of Example 54;

ii) fusosomes in the sample fuse at a higher rate with a target cell than other fusosomes, e.g., by at least 10%, 20%, 30%, 40%, 50%, 60%, 70%, 80%, or 90%, e.g., in an assay of Example 54;

iii) fusosomes in the sample fuse with target cells at a rate such that a membrane protein payload agent in the fusosome is delivered to at least 10%, 20%, 30%, 40%, 50%, 60%, 70%, 80%, or 90%, of target cells after 24, 48, or 72 hours, e.g., in an assay of Example 54;

iv) the fusogen is present at a copy number, per fusosome (e.g., on average in the sample), of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000, 000, 100,000,000, 500,000,000, or 1,000,000,000 copies, e.g., as measured by an assay of Example 29;

v) the membrane protein payload agent is detectable in fusosomes of the sample (e.g., on average in the sample) at a copy number of at least, or no more than, 10, 50, 100, 500, 1,000, 2,000, 5,000, 10,000, 20,000, 50,000, 100,000, 200,000, 500,000 1,000, 000, 5,000,000, 10,000,000, 50,000,000, 100,000, 000, 500,000,000, or 1,000,000,000 copies, e.g., as measured by an assay of Example 43;

vi) the ratio of the copy number of the fusogen to the copy number of the membrane protein payload agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

vii) fusosomes of the sample are characterized by a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, 50%, or 75% of the corresponding lipid level in the source cell;

viii) fusosomes of the sample are characterized by a proteomic composition similar to that of the source cell, e.g., using an assay of Example 42;

ix) fusosomes of the sample are characterized by a ratio of lipids to proteins that is within 10%, 20%, 30%, 40%, or 50% of the corresponding ratio in the source cell, e.g., as measured using an assay of Example 49;

x) fusosomes of the sample are characterized by a ratio of proteins to nucleic acids (e.g., DNA) that is within 10%, 20%, 30%, 40%, or 50% of the corresponding ratio in the source cell, e.g., as measured using an assay of Example 50;

xi) fusosomes of the sample are characterized by a ratio of lipids to nucleic acids (e.g., DNA) that is within 10%, 20%, 30%, 40%, or 50% of the corresponding ratio in the source cell, e.g., as measured using an assay of Example 51;

xii) fusosomes of the sample are characterized by a half-life in a subject, e.g., in a an experimental animal such as a mouse, that is within 1%, 2%, 3%, 4%, 5%, 10%, 20%, 30%, 40%, 50%, 60%, 70%, 80%, 90%, 100% of the half life of a reference cell, e.g., the source cell, e.g., by an assay of Example 75;

xiii) fusosomes of the sample are characterized in that they transport glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more than a negative control, e.g., fusosomes of an otherwise similar sample in the absence of glucose, e.g., as measured using an assay of Example 64;

xiv) fusosomes of the sample are characterized by esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 66;

xv) fusosomes of the sample are characterized by a metabolic activity (e.g., citrate synthase activity) level that is within 1%, 2%, 3%, 4%, 5%, 10%, 20%, 30%, 40%, 50%, 60%, 70%, 80%, 90%, or 100% of the metabolic activity, e.g., citrate synthase activity, in a reference cell, e.g., the source cell, e.g., as described in Example 68;

xvi) fusosomes of the sample are characterized by a respiration level (e.g., oxygen consumption rate) that is within 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 69;

xvii) fusosomes of the sample are characterized by an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70, xviii) fusosomes of the sample are characterized by a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 39;

xix) the fusosome has a soluble:non-soluble protein ratio is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 47;

xx) fusosomes of the sample are characterized by an LPS level less than 5%, 1%, 0.5%, 0.01%, 0.005%, 0.0001%, 0.00001% or less of the LPS content of the source cell or a reference cell, e.g., as measured by an assay of Example 48;

xxi) fusosomes of the sample are capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 63;

xxii) fusosomes of the sample are characterized by a juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 71;

xxiii) fusosomes of the sample are characterized by a paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 72;

xxiv) fusosomes of the sample are characterized in that they polymerize actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 73;

xxv) fusosomes of the sample are characterized by a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 74, or wherein the fusosome has a membrane potential of about −20 to ~150 mV, −20 to −50 mV, −50 to −100 mV, or −100 to −150 mV;

xxvi) fusosomes of the sample are capable of secreting a protein, e.g., at a rate at least 1%, 2%, 3%, 4%, 5%, 10%, 20%, 30%, 40%, 50%, 60%, 70%, 80%, 90%, or 100% greater than the a reference cell, e.g., a mouse embryonic fibroblast, e.g., using an assay of Example 62; or xxvii) fusosomes of the sample are characterized by low immunogenicity, e.g., as described herein.

106. The method of embodiment 104 or 105, further comprising:

c) approving the plurality of fusosomes or fusosome composition for release if one or more of the standards is met or (optionally) formulating the plurality of fusosomes or the fusosome preparation as a drug product if the one or more standards is met.

107. A method of manufacturing a fusosome composition, comprising:

a) providing a source cell comprising, e.g., expressing, a fusogen;

b) producing a fusosome from the source cell, wherein the fusosome comprises a lipid bilayer, a lumen, a fusogen, and a membrane protein payload agent, thereby making a fusosome; and c) formulating the fusosome, e.g., as a pharmaceutical composition suitable for administration to a subject, wherein one or more of:

i) the source cell is other than a 293 cell, HEK cell, human endothelial cell, or a human epithelial cell;

ii) the fusogen is other than a viral protein;

iii) the fusosome and/or compositions or preparations thereof has a density of other than between 1.08 g/mL and 1.12 g/mL, e.g., iv) the fusosome and/or compositions or preparations thereof has a density of 1.25 g/mL+/−0.05, e.g., as measured by an assay of Example 33;

v) the fusosome is not captured by the scavenger system in circulation or by Kupffer cells in the sinus of the liver;

vi) the fusosome is not captured by the reticuloendothelial system (RES) in a subject, e.g., by an assay of Example 76;

vii) when a plurality of fusosomes are administered to a subject, less than 1%, 2%, 3%, 4%, 5%, 10%, 20%, 30%, 40%, 50%, 60%, 70%, 80%, 90%, of the plurality are not captured by the RES after 24 hours, e.g., by an assay of Example 76;

viii) the fusosome has a diameter of greater than 5 μm, 6 μm, 7 μm, 8 μm, 10 μm, 20 μm, 50 μm, 100 μm, 150 μm, or 200 μm.

ix) the fusosome comprises a cytobiologic;

x) the fusosome comprises an enucleated cell; or xi) the fusosome comprises an inactivated nucleus.

108. A method of manufacturing a fusosome composition, comprising:

a) providing a plurality of fusosomes, a fusosome composition, or a pharmaceutical composition as described herein; and b) assaying one or more fusosomes from the plurality to determine whether one or more (e.g., 2, 3, or all) of the following standards are met:

i) the fusosome fuses at a higher rate with a target cell than with a non-target cell, e.g., by at least at least 10% e.g., in an assay of Example 54;

ii) the fusosome fuses at a higher rate with a target cell than with other fusosomes, e.g., by at least 50% e.g., in an assay of Example 54;

iii) the fusosome fuses with target cells at a rate such that an agent in the fusosome is delivered to at least 10% of target cells after 24 hours, e.g., in an assay of Example 54;

iv) the fusogen is present at a copy number of at least 1,000 copies, e.g., as measured by an assay of Example 29;

v) the fusosome comprises a membrane protein payload agent at a copy number of at least 1,000 copies, e.g., as measured by an assay of Example 43;

vi) the ratio of the copy number of the fusogen to the copy number of the membrane protein payload agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

vii) the fusosome comprises a lipid composition wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;

viii) the fusosome comprises a proteomic composition similar to that of the source cell, e.g., using an assay of Example 42;

ix) the fusosome comprises a ratio of lipids to proteins that is within 10%, 20%, 30%, 40%, or 50% of the corresponding ratio in the source cell, e.g., as measured using an assay of Example 49;

x) the fusosome comprises a ratio of proteins to nucleic acids (e.g., DNA) that is within 10%, 20%, 30%, 40%, or 50% of the corresponding ratio in the source cell, e.g., as measured using an assay of Example 50;

xi) the fusosome comprises a ratio of lipids to nucleic acids (e.g., DNA) that is within 10%, 20%, 30%, 40%, or 50% of the corresponding ratio in the source cell, e.g., as measured using an assay of Example 51;

xii) the fusosome has a half-life in a subject, e.g., in a mouse, that is within 90% of the half-life of a reference cell, e.g., the source cell, e.g., by an assay of Example 75;

xiii) the fusosome transports glucose (e.g., labeled glucose, e.g., 2-NBDG) across a membrane, e.g., by at least 10% more than a negative control, e.g., an otherwise similar fusosome in the absence of glucose, e.g., as measured using an assay of Example 64;

xiv) the fusosome comprises esterase activity in the lumen that is within 90% of that of the esterase activity in a reference cell, e.g., the source cell or a mouse embryonic fibroblast, e.g., using an assay of Example 66;

xv) the fusosome comprises a metabolic activity level that is within 90% of the metabolic activity (e.g., citrate synthase activity) in a reference cell, e.g., the source cell, e.g., as described in Example 68;

xvi) the fusosome comprises a respiration level (e.g., oxygen consumption rate) that is within 90% of the respiration level in a reference cell, e.g., the source cell, e.g., as described in Example 69;

xvii) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70;

xviii) the fusosome has a miRNA content level of at least 1% than that of the source cell, e.g., by an assay of Example 39;

xix) the fusosome has a soluble:non-soluble protein ratio is within 90% of that of the source cell, e.g., by an assay of Example 47;

xx) the fusosome has an LPS level less than 5% of the lipid content of fusosomes, e.g., as measured by an assay of Example 48;

xxi) the fusosome and/or compositions or preparations thereof, are capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

xxii) the fusosome has juxtacrine-signaling level of at least 5% greater than the level of juxtacrine signaling induced by a reference cell, e.g., the source cell or a bone marrow stromal cell (BMSC), e.g., by an assay of Example 71;

xxiii) the fusosome has paracrine-signaling level of at least 5% greater than the level of paracrine signaling induced by a reference cell, e.g., the source cell or a macrophage, e.g., by an assay of Example 72;

xxiv) the fusosome polymerizes actin at a level within 5% compared to the level of polymerized actin in a reference cell, e.g., the source cell or a C2C12 cell, e.g., by the assay of Example 73;

xxv) the fusosome has a membrane potential within about 5% of the membrane potential of a reference cell, e.g., the source cell or a C2C12 cell, e.g., by an assay of Example 74, or wherein the fusosome has a membrane potential of about −20 to −150 mV, −20 to −50 mV, −50 to −100 mV, or −100 to −150 mV;

xxvi) the fusosome and/or compositions or preparations thereof, are capable of secreting a protein, e.g., at a rate at least 5% greater than a reference cell, e.g., a mouse embryonic fibroblast, e.g., using an assay of Example 62; or xxvii) the fusosome has low immunogenicity, e.g., as described herein; and c) optionally, approving the plurality of fusosomes or fusosome composition for release if one or more of the standards is met;

thereby manufacturing a fusosome drug product composition.

109. A method of delivering a membrane protein payload agent to a subject, comprising administering to the subject a fusosome composition comprising a plurality of fusosomes according to any of embodiments 1-70, a fusosome composition of any of embodiments 71-97, or a pharmaceutical composition of embodiment 97, wherein the fusosome composition is administered in an amount and/or time such that the membrane protein payload agent is delivered.

110. A method of delivering a fusosome composition or preparation comprising a membrane protein payload agent, e.g., as described herein, to a human subject, a target tissue, or a cell, the method comprising administering to the human subject, or contacting the target tissue or the cell with, a fusosome composition comprising a plurality of fusosomes described herein, a fusosome composition described herein, or a pharmaceutical composition described herein, thereby administering the fusosome composition to the subject.

111. A method of delivering a membrane protein payload agent to a subject, a target tissue, or a cell, comprising administering to the subject, or contacting the target tissue or the cell with, a fusosome composition or preparation described herein (e.g., a pharmaceutical composition described herein), wherein the fusosome composition or preparation is administered in an amount and/or time such that the membrane protein payload agent is delivered.

112. A method of delivering a membrane protein payload agent to a subject, for example comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition or preparation as described herein, comprising a plurality of fusosomes comprising a second fusogen and a membrane protein payload agent, wherein the second fusogen is compatible with the first fusogen, wherein the plurality of fusosomes further comprise a membrane protein payload agent, thereby delivering the membrane protein payload agent to the subject.

113. A method of modulating, e.g., enhancing, a biological function in a subject, comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition or preparation as described herein, comprising a plurality of fusosomes comprising a second fusogen, wherein the second fusogen is compatible with the first fusogen, wherein the plurality of fusosomes further comprise a membrane protein payload agent, thereby modulating the biological function in the subject.

114. A method of delivering or targeting a membrane protein function to a subject, comprising administering to the subject a fusosome composition or preparation described herein which comprises a membrane protein payload agent, wherein the fusosome composition or preparation is administered in an amount and/or time such that the membrane protein function is delivered or targeted in the subject, optionally wherein the subject has a cancer, an inflammatory disorder, autoimmune disease, a chronic disease, inflammation, damaged organ function, an infectious disease, a degenerative disorder, a genetic disease, or an injury.

115. A method of administering a fusosome composition to a human subject, comprising:

a) administering to the subject a first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition comprising a plurality of fusosomes comprising a second fusogen, wherein the second fusogen is compatible with the first fusogen, wherein the plurality of fusosomes further comprise a membrane protein payload agent;

thereby administering the fusosome composition to the subject.

116. A method of delivering a membrane protein payload agent to a subject, comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition comprising a plurality of fusosomes comprising a second fusogen and a therapeutic agent, wherein the second fusogen is compatible with the first fusogen, wherein the plurality of fusosomes further comprise a membrane protein payload agent;

thereby delivering the membrane protein payload agent to the subject.

117. A method of modulating, e.g., enhancing, a biological function in a subject, comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or
ii) the first fusogen does not comprise a coiled-coil motif, and
b) administering to the human subject a fusosome composition comprising a plurality of fusosomes comprising a second fusogen, wherein the second fusogen is compatible with the first fusogen, wherein the plurality of fusosomes further comprise a membrane protein payload agent;
thereby modulating the biological function in the subject.
118. The method of embodiment 117, wherein the biological function is selected from:
a) modulating, e.g., increasing or decreasing, an interaction between two cells;
b) modulating, e.g. increasing or decreasing, an immune response;
c) modulating, e.g. increasing or decreasing, recruitment of cells to a target tissue;
d) decreasing the growth rate of a cancer; or
e) reducing the number of cancerous cells in the subject.
119. The method of any of embodiments 115-118, wherein the membrane protein payload agent is exogenous or overexpressed relative to the source cell.
120. The method of any of embodiments 115-119, wherein the membrane protein payload agent comprises or encodes one or more of:
i) a chimeric antigen receptor;
ii) an integrin membrane protein payload, e.g., chosen from Table 7;
iii) an ion channel protein chosen from Table 8;
iv) a pore forming protein, e.g., chosen from Tables 9 and 10;
v) a Toll-Like Receptor, e.g., chosen from Table 11;
vi) an interleukin receptor payload, e.g., chosen from Table 12;
vii) a cell adhesion protein chosen from Tables 13-14;
viii) a transport protein chosen from Table 17;
ix) a signal sequence that is heterologous relative to the naturally-occurring membrane protein; or
x) a signal sequence listed in Table 6.
121. The method of any of embodiments 115-120, wherein the membrane protein payload agent is other than, does not comprise, does not encode, or is not complementary to a sequence that encodes, a connexin, CFTR, thyrotropin receptor, myelin protein zero, melacortin 4, myelin proteolipid protein, low-density lipoprotein receptor, ABC transporter, CD81, mCAT-1, CXCR4, CD4, CCR5, sialic acid-rich proteins, claudins, CD21, T-cell receptors, B cell receptors, TNFR1, CD63, GLUT4, VEGF, or ICAM.
122. The method of any of embodiments 115-121, wherein the membrane protein payload agent comprises or encodes a chimeric protein which does not bind a cell surface marker or target cell moiety of a target cell and which does not comprise a fluorescent protein.
123. The method of any of embodiments 115-122, wherein the membrane protein payload agent:
a) comprises a therapeutic protein, e.g., a therapeutic protein described herein;
b) comprises a Golgi apparatus protein, a secreted protein, or an endoplasmic reticulum protein, or a combination thereof;
c) does not comprise one or more of: a dimer (e.g., a dimer that is exogenous to the source cell), a heterodimer (e.g., a heterodimer that is exogenous to the source cell), or a dimerization domain (e.g., a dimerization domain in a polypeptide that is exogenous to the source cell);
d) comprises a nucleic acid (e.g., DNA or RNA) encoding a membrane protein.
124. The method of any of embodiments 115-123, wherein the membrane protein payload agent comprises or encodes:
a) a membrane protein that comprises a transmembrane domain;
b) a lipid-anchored protein;
c) a protein that binds a transmembrane protein (e.g., an extracellular protein that binds an extracellular portion of a transmembrane protein or an intracellular protein that binds an intracellular portion of a transmembrane protein);
d) a protein that lacks a transmembrane domain;
e) a protein that partially spans a membrane (e.g., a membrane of the target cell or the fusosome) and does not completely span the membrane (e.g., comprising an in-plane membrane helix or the protein comprises a hydrophobic loop that does not completely span the membrane); or
f) a protein that does not comprise a transmembrane domain, wherein the protein interacts with a membrane surface, e.g., through electrostatic or ionic interactions.
125. The method of any of embodiments 115-124, wherein the first fusogen is not a lipopeptide.
126. The method of any of embodiments 109-125, further comprising a step of:
monitoring one or more of cancer progression, tumor recession, tumor volume, decrease in neoplastic cell number, quantity of fused cells, quantity of fused cells comprising a membrane protein payload agent, quantity of fused cells expressing a nucleic acid protein payload, and quantity of membrane protein disposed in membrane of a fused cell.
127. The fusosome, fusosome composition, fusosome preparation, or method of any of the preceding embodiments, wherein the membrane protein payload agent is or comprises:
a) a sequence of SEQ ID NOs: 8144-16131 of U.S. Patent Publication No. 2016/0289674;
b) a fragment, variant, or homolog of a sequence of SEQ ID NOs: 8144-16131 of U.S. Patent Publication No. 2016/0289674;
c) a nucleic acid encoding a protein comprising a sequence of SEQ ID NOs: 8144-16131 of U.S. Patent Publication No. 2016/0289674; or
d) a nucleic acid encoding a protein comprising a fragment, variant, or homolog of a sequence of SEQ ID NOs: 8144-16131 of U.S. Patent Publication No. 2016/0289674.
128. The fusosome, fusosome composition, fusosome preparation, or method of any of the preceding embodiments, wherein the membrane protein payload agent is or comprises:
a) a protein selected from Tables 7-17;
b) a fragment, variant, or homolog of a protein selected from Tables 7-17;
c) a nucleic acid encoding a protein which is or comprises a protein selected from Tables 7-17; or d) a nucleic acid encoding a protein comprising a fragment, variant, or homolog of a protein selected from Tables 7-17.

129. The fusosome, fusosome composition, fusosome preparation, or method of any of the preceding embodiments, wherein the membrane protein payload agent is or comprises a chimeric antigen receptor (CAR) comprising an antigen binding domain.

130. The fusosome, fusosome composition, fusosome preparation, or method of any of the preceding embodiments, wherein the membrane protein provided by or as a membrane protein payload agent as described herein is or comprises an immunoglobulin moiety or entity (e.g., an antibody, a Fab, an scFV, an scFab, a sdAb, a duobody, a minibody, a nanobody, a diabody, a zybody, a camelid antibody, a BiTE, a quadroma, or a bsDb).

131. The fusosome, fusosome composition, fusosome preparation, or method of any of the preceding embodiments, wherein the membrane protein provided by or as a membrane protein payload agent as described herein is or comprises one or more cell surface ligands (e.g., 1, 2, 3, 4, 5, 10, 20, 50, or more cell surface ligands), and/or wherein the membrane protein provided by or as a membrane protein payload agent as described herein presents one or more cell surface ligands, e.g., to a target cell.

132. The fusosome, fusosome composition, fusosome preparation, or method of any of the preceding embodiments, wherein the fusosome, and/or composition or preparation thereof, comprises (e.g., is capable of delivering to the target cell) a plurality of agents (e.g., at least 2, 3, 4, 5, 10, 20, or 50 agents), wherein at least one agent is or comprises a membrane protein payload; optionally, wherein one or more of the agents is or comprises an inhibitory nucleic acid (e.g., siRNA or miRNA) and/or an mRNA.

133. The fusosome, fusosome composition, fusosome preparation, or method of any of the preceding embodiments, wherein the fusosome, and/or composition or preparation thereof, comprises (e.g., is capable of delivering to the target cell) a membrane protein payload agent are capable of reprogramming or transdifferentiating a target cell, e.g., the fusosome (and/or composition thereof) comprises one or more agents that induce reprogramming or transdifferentiation of a target cell.

134. The fusosome, fusosome composition, fusosome preparation, or method of any of the preceding embodiments, wherein:

a) the fusosome delivers to a target cell at least 10%, 20%, 30%, 40%, 50%, 60%, 70%, 80%, 90%, 95%, 96%, 97%, 98%, or 99% of a membrane protein payload agent (e.g., a therapeutic agent, e.g., a therapeutic agent that is endogenous or exogenous relative to the source cell) comprised by the fusosome;

b) the fusosomes that fuse with the target cell(s) deliver to the target cell an average of at least 10%, 20%, 30%, 40%, 50%, 60%, 70%, 80%, 90%, 95%, 96%, 97%, 98%, or 99% of the membrane protein payload agent (e.g., a therapeutic membrane protein payload agent, e.g., an endogenous therapeutic membrane protein payload agent or a therapeutic membrane protein payload agent that is exogenous relative to the source cell) comprised by the fusosomes that fuse with the target cell(s); and/o c) the fusosome composition delivers to a target tissue at least 10%, 20%, 30%, 40%, 50%, 60%, 70%, 80%, 90%, 95%, 96%, 97%, 98%, or 99% of the membrane protein payload agent (e.g., a membrane protein payload agent, e.g., a therapeutic membrane protein payload agent that is exogenous relative of the source cell) comprised by the fusosome composition.

135. The fusosome, fusosome composition, fusosome preparation, or method of any of the preceding embodiments, wherein the fusosome, and/or composition or preparation thereof, delivers or is capable of delivering (e.g., deliver) a membrane protein payload agent (e.g., a therapeutic agent) that is characterized by a half-life in a subject that is longer than the half-life of the fusosome, e.g., by at least 10%, 20%, 50%, 2-fold, 5-fold, or 10-fold.

136. The fusosome, fusosome composition, fusosome preparation, or method of embodiment 306, wherein the fusosome delivers the therapeutic agent to the target cell, optionally wherein the agent is present after the fusosome is no longer present or detectable.

137. The fusosome, fusosome composition, fusosome preparation, or method of any of the preceding embodiments, wherein the fusosome comprises a therapeutic membrane protein payload agent, e.g., a therapeutic membrane protein payload agent, e.g., a therapeutic membrane protein payload agent that is exogenous or endogenous relative to the source cell, optionally wherein the therapeutic membrane protein payload agent is chosen from one or more of a protein, e.g., a transmembrane protein, a cell surface protein, a secreted protein, a receptor, an antibody; a nucleic acid, e.g., DNA, a chromosome (e.g. a human artificial chromosome), RNA, or mRNA.

Delivery to the Nucleus

138. A fusosome comprising:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer; and (d) a nuclear payload agent, e.g., a nuclear protein payload agent (e.g., which is exogenous or overexpressed relative to the source cell), wherein:

i) when a target cell is contacted with a plurality of the fusosomes, the nuclear protein payload agent or a protein encoded therein becomes present in the nucleus of the target cell at a level at least 10%, 20%, 50%, 100%, 2-fold, 5-fold, 10-fold, 20-fold, 50-fold, or 100-fold higher than the level of the nuclear protein payload agent in the cytoplasm of the target cell, e.g., by an assay of any of Examples 117-122;

ii) when a population of target cells is contacted with a plurality of the fusosomes, the nuclear protein payload agent or a protein encoded therein becomes enriched (e.g., present in the nucleus of the target cell at a level at least 50% higher than the level of the nuclear protein payload agent in the cytoplasm of the target cell) in the nucleus of at least 5%, 10%, 20%, 30%, 40%, 50%, 60%, 70%, 80%, 90%, or 95% of cells in the population of target cells, e.g., as measured in an assay of any of Examples 117-122;

iii) when a population of target cells is contacted with a plurality of the fusosomes, the nuclear protein payload agent or a protein encoded therein becomes present in a sub-population (the "fused population") of the population of target cells, wherein the nuclear protein payload agent or protein encoded therein becomes enriched in the nucleus (e.g., present in the nucleus of the target cell at a level at least 50% higher than the level of the nuclear protein payload agent in the cytosol of the target cell), in at least 5%, 10%, 20%, 30%, 40%, 50%, 60%, 70%, 80%, 90%, or 95% of cells in the fused population, e.g., as measured in an assay of any of Examples 117-122 iv) when a population of target cells is contacted with a plurality of the fusosomes, the nuclear protein payload agent or a protein encoded therein becomes present in a sub-population (the "recipient cell population") of the population of target cells, wherein the nuclear protein payload agent or protein encoded therein becomes enriched in the nucleus (e.g., present in the nucleus of the target cell at a level at least 50% higher than the level of the nuclear protein payload agent in the cytoplasm of the target cell), in at least 5%, 10%, 20%, 30%, 40%, 50%, 60%, 70%, 80%, 90%, or 95% of cells in the recipient cell population, e.g., as measured in an assay of any of Examples 117-122;

v) at least 1, 2, 5, 10, 20, 50, 100, 200, 500, or 1,000 copies of the nuclear protein payload agent, or a protein encoded by a nucleic acid nuclear protein payload agent, are present in the nucleus in a target cell, e.g., as measured in an assay of Example 117 or 118;

vi) the nuclear protein payload agent comprises or encodes one or more of a transcriptional activator, transcriptional repressor, epigenetic modifier, histone acetyltransferase, histone deacetylase, histone methyltransferase, DNA methyltransferase, a DNA nickase, a site-specific DNA editing enzyme e.g. a deaminase, DNA transposase, DNA integrase, an RNA editor, an RNA splicing factor, a PIWI protein;

vii) the nuclear protein payload agent comprises or encodes one or more of a basic helix-loop helix motif, leucine zipper motif, helix-turn-helix motif, homeodomain motif, a winged helix motif, a winged helix-turn motif, a HMG-box domain, a Wor3 domain, an OB-fold domain, a zinc finger motif, a TAL effector, or a B3 domain;

viii) the nuclear protein payload agent comprises a complex comprising a homodimer, a heterodimer, a homotrimer, a heterotrimer, a homotetramer, or a heterotetramer;

ix) the nuclear protein payload agent comprises or encodes a heterologous nuclear localization signal, and wherein the nuclear protein payload agent does not comprise a site-specific nuclease such as Cre;

x) the nuclear protein payload agent comprises or encodes a nuclear localization signal listed in Table 6-1, optionally wherein the NLS comprises an amino acid sequence set forth in any one of SEQ ID NOS: 128-507 and 605-626; or xi) the nuclear protein payload agent comprises or encodes a protein that is preferentially enriched in the nucleoplasm, nucleolus, perionucleolar region, a Cajal body, a clastosome, a gems nuclear body, a histone locus body (HLB), a nuclear speckle, a nuclear stress body, a paraspeckle, a PML body, a polycomb body; or xii) the nuclear protein payload agent comprises or encodes a protein comprising a first domain that binds an endogenous protein present (at least partly) in the cytoplasm of a target cell and a second domain that promotes nuclear import, e.g., an NLS.

139. The fusosome of embodiment 138, wherein the payload that is in an endocytic vesicle is in the cytoplasm of a target cell.

140. A fusosome comprising:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer; and (d) a nuclear payload agent, e.g., a nuclear protein payload agent (e.g., which is exogenous or overexpressed relative to the source cell), wherein:

i) the fusosome comprises or is comprised by a cytobiologic;

ii) the fusogen is present at a copy number of at least 1,000 copies, e.g., as measured by an assay of Example 29;

iii) the fusosome comprises a therapeutic agent at a copy number of at least 1,000 copies, e.g., as measured by an assay of Example 43;

iv) the fusosome comprises a lipid wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;

v) the fusosome comprises a proteomic composition similar to that of the source cell, e.g., using an assay of Example 42;

vi) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

vii) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, or 10%, of the fusosomes in a population of administered fusosomes are present in the target tissue after 24 hours, e.g., by an assay of Example 87 or 100; or viii) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell.

141. A fusosome comprising:

(a) a lipid bilayer comprising a plurality of lipids derived from a source cell;

(b) a lumen (e.g., comprising cytosol) surrounded by the lipid bilayer;
(c) a fusogen that is exogenous or overexpressed relative to the source cell, e.g., wherein the fusogen is disposed in the lipid bilayer; and
(d) a nuclear payload agent comprising (i) a nucleic acid, and (ii) a protein that promotes nuclear import of the nucleic acid.

142. The fusosome of any of the preceding embodiments, wherein the nuclear protein payload agent (e.g., which is exogenous or overexpressed relative to the source cell) comprises or encodes one or more of:
i) a transcriptional activator, e.g., a transcriptional activator of Table 17-1;
ii) a transcriptional repressor, e.g., a transcriptional repressor of Table 17-1;
iii) an epigenetic modifier, e.g., an epigenetic modifier of Table 17-1;
iv) a histone acetyltransferase, e.g., a histone acetyltransferase of Table 17-1;
v) a histone deacetylase, e.g., a histone deacetylase of Table 17-1;
vi) a histone methyltransferase, e.g., a histone methyltransferase of Table 17-1;
vii) a DNA methyltransferase, e.g., a DNA methyltransferase of Table 17-1;
viii) a DNA nickase, e.g., a DNA nickase as described herein;
ix) a site-specific DNA editing enzyme, e.g., a deaminase, e.g., of Table 17-1;
x) a DNA transposase, e.g., a DNA transposase as described herein;
xi) a DNA integrase, e.g., a DNA integrase as described herein;
xii) an RNA editor, e.g., an RNA editor of Table 17-1;
xiii) an RNA splicing factor, e.g., an RNA splicing factor of Table 17-1; or
xiv) a PIWI protein, e.g., a PIWI protein as described herein;

143. The fusosome of any of the preceding embodiments, wherein the nuclear protein payload agent comprises or encodes a protein having a NLS which is the same as the NLS in a naturally-occurring counterpart of the protein.

144. The fusosome of any of the preceding embodiments, wherein the nuclear protein payload agent comprises or encodes a protein having a NLS which is not comprised by a naturally-occurring counterpart of the protein.

145. The fusosome of any of the preceding embodiments, wherein the nuclear protein payload agent comprises or encodes: a transcription factor, a nuclease, a recombinase, an epigenetic factor, a post-transcriptional RNA modification factor (e.g., an mRNA splicing factor), a non-coding RNA (e.g. a snRNA or snoRNA) or ribonucleic protein (e.g. a snRNP or snoRNP), a structural protein (e.g. a lamin or karysokeletal protein).

146. The fusosome of any of the preceding embodiments, wherein the nuclear protein payload agent comprises or encodes an antibody molecule, e.g., a Fab, an scFv, an scFab, a sdAb, a duobody, a minibody, a nanobody, a diabody, a zybody, a camelid antibody, a BiTE, a quadroma, or a bsDb.

147. The fusosome of any of the preceding embodiments, wherein the nuclear protein payload agent comprises or encodes a fusion protein comprising an effector domain and a localization domain.

148. The fusosome of embodiment 147, wherein the localization domain comprises a TAL domain, a Zinc Finger domain, a Cas9 domain, or a meganuclease domain.

149. The fusosome of embodiment 147 or 148, wherein the effector domain comprises a nuclease, recombinase, integrase, base editor (deaminase), transcription factor, or epigenetic modifier.

150. The fusosome of any of the preceding embodiments, wherein the nuclear protein payload agent comprises or encodes a gene editing protein or nucleic acid, e.g., Cas9 or a guide RNA.

151. The fusosome of any of the preceding embodiments, wherein the nuclear payload agent comprises a functional RNA.

152. The fusosome of any of the preceding embodiments, wherein the nuclear payload agent comprises a nuclear protein payload agent, e.g., a protein or an mRNA encoding the protein.

153. The fusosome of any of the preceding embodiments, wherein the nuclear payload agent comprises (i) a nucleic acid, and (ii) a protein that promotes nuclear import of the nucleic acid.

154. The fusosome of embodiment 153, wherein the nucleic acid comprises a binding site, and the protein that promotes nuclear import binds to the binding site.

155. The fusosome of embodiment 154, wherein the binding site comprises a TetR binding site and the protein comprises TetR.

156. The fusosome of any of the preceding embodiments, wherein the nuclear payload agent comprises a synthetic transcription factor, e.g., a fusion protein comprising (i) a DNA binding domain, e.g., a specific DNA binding domain, e.g., TAL domain, ZF domain, or Cas9 domain and (ii) a transcriptional activator domain or transcriptional repressor domain.

157. The fusosome of any of the preceding embodiments, wherein the nuclear payload agent comprises a synthetic epigenetic modifier, e.g., a fusion protein comprising (i) a DNA binding domain and (ii) an epigenetic modifier domain.

158. The fusosome of any of the preceding embodiments, wherein the nuclear protein payload agent is or comprises a protein selected from Table 17-1.

159. The fusosome of any of the preceding embodiments, wherein the nuclear protein payload agent is or comprises a fragment, variant, or homolog of a protein selected from Tables 17-1.

160. The fusosome of any of the preceding embodiments, wherein the nuclear protein payload agent is or comprises a nucleic acid encoding a protein which is or comprises a protein selected from Tables 17-1.

161. The fusosome of any of the preceding embodiments, wherein the nuclear protein payload agent is or comprises a nucleic acid encoding a protein comprising a fragment, variant, or homolog of a protein selected from Tables 17-1.

Organellar Delivery

162. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an organellar payload agent, e.g., a organellar protein payload agent (e.g., which is exogenous or overexpressed relative to the source cell), wherein, when a target cell is contacted with a plurality of the fusosomes, the organellar protein payload agent or polypeptide encoded therein becomes enriched in mitochondria of the target cell at a level at least 10%, 20%, 50%, 100%, 2-fold, 5-fold, 10-fold, 20-fold, 50-fold, or 100-fold higher than the level of the organellar protein payload agent in the cytoplasm or the target cell plasma membrane.

163. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an organellar protein payload agent that comprises or encodes a heterologous signal sequence to the organellar protein payload agent (e.g., a signal sequence of Table 6 or 6-1) that is sufficient to enrich the organellar protein payload agent, or polypeptide encoded therein, in a cytoplasmic organelle of the target cell, optionally wherein the heterologous signal sequence is set forth in any one of SEQ ID NOS: 39-127 and 605-626.

164. A fusosome comprising:
(a) a lipid bilayer comprising a plurality of lipids derived from a source cell;
(b) a lumen surrounded by the lipid bilayer, wherein the lumen does not comprise an organelle;
(c) a fusogen that is exogenous or overexpressed relative to the source cell, e.g., wherein the fusogen is disposed in the lipid bilayer; and
(d) an organellar protein payload agent (e.g., which is exogenous or overexpressed relative to the source cell), wherein, when a target cell is contacted with a plurality of the fusosomes, the organellar protein payload agent or polypeptide encoded therein becomes enriched in one or more of the Golgi apparatus, endoplasmic reticulum, vacuole, acrosome, autophagosome, centriole, glycosome, glyoxysome, hydrogenosome, melanosome, mitosome, cnidocyst, peroxisome, proteasome, vesicle, or stress granule of the target cell relative to the cyosol or plasma membrane of the target cell.

165. A fusosome comprising:
(a) a lipid bilayer comprising a plurality of lipids derived from a source cell;
(b) a lumen surrounded by the lipid bilayer, wherein the lumen does not comprise an organelle;
(c) a fusogen that is exogenous or overexpressed relative to the source cell, e.g., wherein the fusogen is disposed in the lipid bilayer; and
(d) an organellar protein payload agent that comprises a nucleic acid encoding a polypeptide, wherein, when a target cell is contacted with a plurality of the fusosomes, the encoded polypeptide becomes enriched in the lysosome and/or endosome, relative to the cytosol or plasma membrane of the target cell.

166. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an exogenous or overexpressed organellar protein payload agent, wherein the organellar protein payload agent comprises or encodes a polypeptide chosen from a mitochondrial membrane protein, a outer mitochondrial membrane protein, an inner mitochondrial membrane protein, a mitochondrial inner boundary membrane protein, a mitochondrial cristal membrane protein, a mitochondrial DNA protein, a mitochondrial intermembrane space protein, a mitochondrial matrix protein, a mitochondrial matrix granule protein, a mitochondrial cristae protein, a mitochondrial ribosome protein, a mitochondrial intracristal protein, a mitochondrial peripheral space protein, a peroxisomal membrane protein, a peroxisomal crystalloid core protein, a peroxisomal matrix protein, a peroxin.

167. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an exogenous or overexpressed organellar protein payload agent, wherein the organellar protein payload agent comprises or encodes a polypeptide chosen from:
i) a metabolic protein (e.g., an electron transport chain protein or ATP synthase)
ii) a protease;
iii) a chaperone;
iv) a protein transport protein;
v) a mitochondrial ribosome protein;
vi) a mitochondrial transcription protein; or
vii) a mitochondrial replication protein.

168. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an organellar protein payload agent (e.g., which is exogenous or overexpressed relative to the source cell), that comprises or encodes a first domain that binds an endogenous protein present (at least partly) in the cytosol or nucleus of a target cell and a second domain that promotes import into a cytoplasmic organelle of the target cell.

169. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and
(d) an organellar protein payload agent comprising (i) a nucleic acid, and (ii) a protein that promotes import of the nucleic acid into a cytoplasmic organelle.

170. A fusosome comprising:
(a) a lipid bilayer comprising a plurality of lipids derived from a source cell;
(b) a lumen surrounded by the lipid bilayer;
(c) a fusogen that is exogenous or overexpressed relative to the source cell, e.g., wherein the fusogen is disposed in the lipid bilayer; and (d) an organellar protein payload agent (e.g., which is exogenous or overexpressed relative to the source cell), wherein the organellar protein payload agent comprises a nucleic acid (e.g., DNA or RNA), e.g., a functional RNA or a nucleic acid encoding a protein.

171. A fusosome comprising:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer; and (d) an organellar payload agent, e.g., a organellar protein payload agent (e.g., which is exogenous or overexpressed relative to the source cell), wherein:

ix) the fusosome comprises or is comprised by a cytobiologic;

x) the fusogen is present at a copy number of at least 1,000 copies, e.g., as measured by an assay of Example 29;

xi) the fusosome comprises a therapeutic agent at a copy number of at least 1,000 copies, e.g., as measured by an assay of Example 43;

xii) the fusosome comprises a lipid wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;

xiii) the fusosome comprises a proteomic composition similar to that of the source cell, e.g., using an assay of Example 42;

xiv) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

xv) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, or 10%, of the fusosomes in a population of administered fusosomes are present in the target tissue after 24 hours, e.g., by an assay of Example 87 or 100; or xvi) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell.

172. A fusosome comprising:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer; and (d) an organellar payload agent, e.g., a organellar protein payload agent (e.g., which is exogenous or overexpressed relative to the source cell), wherein:

i) the fusosome comprises or is comprised by a cytobiologic;

ii) the fusosome comprises an enucleated cell;

iii) the fusosome comprises an inactivated nucleus;

iv) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold, e.g., in an assay of Example 54;

v) the fusosome fuses at a higher rate with a target cell than with other fusosomes, e.g., by at least 10%, 20%, 30%, 40%, 50%, 60%, 70%, 80%, or 90%, 2-fold, 3-fold, 4-fold, 5-fold, 10-fold, 20-fold, 50-fold, or 100-fold, e.g., in an assay of Example 54;

vi) the fusosome fuses with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 54;

vii) the fusogen is present at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 29;

viii) the fusosome comprises a therapeutic agent at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 43 or 156;

ix) the ratio of the copy number of the fusogen to the copy number of the therapeutic agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

x) the fusosome comprises a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, 50%, 55%, 60%, 65%, 70%, or 75% of the corresponding lipid level in the source cell;

xi) the fusosome comprises a proteomic composition similar to that of the source cell, e.g., using an assay of Example 42 or 155;

xii) the fusosome comprises a ratio of lipids to proteins that is within 10%, 20%, 30%, 40%, or 50% of the corresponding ratio in the source cell, e.g., as measured using an assay of Example 49;

xiii) the fusosome comprises a ratio of proteins to nucleic acids (e.g., DNA) that is within 10%, 20%, 30%, 40%, or 50% of the corresponding ratio in the source cell, e.g., as measured using an assay of Example 50;

xiv) the fusosome comprises a ratio of lipids to nucleic acids (e.g., DNA) that is within 10%, 20%, 30%, 40%, or 50% of the corresponding ratio in the source cell, e.g., as measured using an assay of Example 51 or 159;

xv) the fusosome has a half-life in a subject, e.g., in a mouse, that is within 1%, 2%, 3%, 4%, 5%, 10%, 20%, 30%, 40%, 50%, 60%, 70%, 80%, 90%, 100% of the half life of a reference cell, e.g., the source cell, e.g., by an assay of Example 75;

xvi) the fusosome transports glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more (e.g., about 11.6% more) than a negative control, e.g., an otherwise similar fusosome in the absence of glucose, e.g., as measured using an assay of Example 64;

xvii) the fusosome comprises esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 66;

xviii) the fusosome comprises a metabolic activity level that is within 1%, 2%, 3%, 4%, 5%, 10%, 20%, 30%, 40%, 50%, 60%, 70%, 80%, 90%, or 100% of the citrate synthase activity in a reference cell, e.g., the source cell, e.g., as described in Example 68;

xix) the fusosome comprises a respiration level (e.g., oxygen consumption rate) that is within 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 69;

xx) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70, xxi) the fusosome has a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 39;

xxii) the fusosome has a soluble:non-soluble protein ratio is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 47; xxiii) the fusosome has an LPS level less than 5%, 1%, 0.5%, 0.01%, 0.005%, 0.0001%, 0.00001% or less of the LPS content of the source cell, e.g., as measured by mass spectrometry, e.g., in an assay of Example 48;

xxiv) the fusosome is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 63;

xxv) the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, 0.5%, 1%, 1.5%, 2%, 2.5%, 3%, 4%, 5%, 10%, 20%, 30%, 40%, 50%, 60%, 70%, 80%, or 90% of the fusosomes in a population of administered fusosomes are present in the target tissue after 24, 48, or 72 hours, e.g., by an assay of Example 87 or 100;

xxvi) the fusosome has juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 71;

xxvii) the fusosome has paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 72;

xxviii) the fusosome polymerizes actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 73;

xxix) the fusosome has a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 74, or wherein the fusosome has a membrane potential of about −20 to ~150 mV, −20 to −50 mV, −50 to −100 mV, or −100 to −150 mV;

xxx) the fusosome is capable of extravasation from blood vessels, e.g., at a rate at least 1%, 2%, 5%, 10%, 20%, 30%, 40%, 50%, 60%, 70%, 80%, or 90% the rate of extravasation of the source cell or of a cell of the same type as the source cell, e.g., using an assay of Example 57, e.g., wherein the source cell is a neutrophil, lymphocyte, B cell, macrophage, or NK cell;

xxxi) the fusosome is capable of crossing a cell membrane, e.g., an endothelial cell membrane or the blood brain barrier;

xxxii) the fusosome is capable of secreting a protein, e.g., at a rate at least 1%, 2%, 3%, 4%, 5%, 10%, 20%, 30%, 40%, 50%, 60%, 70%, 80%, 90%, or 100% greater than a reference cell, e.g., a mouse embryonic fibroblast, e.g., using an assay of Example 62;

xxxiii) the fusosome meets a pharmaceutical or good manufacturing practices (GMP) standard;

xxxiv) the fusosome was made according to good manufacturing practices (GMP);

xxxv) the fusosome has a pathogen level below a predetermined reference value, e.g., is substantially free of pathogens;

xxxvi) the fusosome has a contaminant level below a predetermined reference value, e.g., is substantially free of contaminants;

xxxvii) the fusosome has low immunogenicity, e.g., as described herein;

xxxviii) the source cell is selected from a neutrophil, a granulocyte, a mesenchymal stem cell, a bone marrow stem cell, an induced pluripotent stem cell, an embryonic stem cell, a myeloblast, a myoblast, a hepatocyte, or a neuron e.g., retinal neuronal cell; or xxxix) the source cell is other than a 293 cell, HEK cell, human endothelial cell, or a human epithelial cell, monocyte, macrophage, dendritic cell, or stem cell.

173. The fusosome of any of the preceding embodiments, wherein the cytoplasmic organelle is chosen from a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, or stress granule.

174. The fusosome of any of the preceding embodiments, wherein the cytoplasmic organelle is a membrane-bound organelle.

10a. The fusosome of any of the preceding embodiments, wherein the organellar payload agent becomes enriched in one or more of the mitochondrial matrix, mitochondrial intermembrane space, mitochondrial outer membrane, mitochondrial inner membrane, or mitochondrial christae.

175. The fusosome of any of the preceding embodiments, wherein the organellar protein payload agent or polypeptide encoded therein comprises a protein of Table 17-2.

176. The fusosome of any of the preceding embodiments, wherein, when a population of target cells is contacted with a plurality of the fusosomes, the organellar protein payload agent or a polypeptide encoded therein becomes enriched in the cytoplasmic organelle (e.g., present in the cytoplasmic organelle of the target cell at a level at least 50% higher than the level of the organellar protein payload agent in the cytosol of the target cell) of at least 5%, 10%, 20%, 30%, 40%, 50%, 60%, 70%, 80%, 90%, or 95% of cells in the population of target cells, e.g., as measured in an assay of Example 123 or 124.

177. The fusosome of any of the preceding embodiments, wherein, when a population of target cells is contacted with a plurality of the fusosomes, the organellar protein payload agent or a polypeptide encoded therein becomes present in a sub-population (the "fused population") of the population of target cells, wherein the organellar payload agent or protein encoded therein becomes enriched in a cytoplasmic organelle (e.g., present in the cytoplasmic of the target cell at a level at least 50% higher than the level of the organellar protein payload agent or polypeptide encoded therein in the cytosol of the target cell), in at least 5%, 10%, 20%, 30%, 40%, 50%, 60%, 70%, 80%, 90%, or 95% of cells in the fused population, e.g., as measured in an assay of Example 123 or 124.

178. The fusosome of any of the preceding embodiments, wherein at least 1, 2, 5, 10, 20, 50, 100, 200, 500, or 1,000 copies of the organellar protein payload agent, or a polypeptide encoded therein, are present in the cytoplasmic organelle in a target cell contacted with a plurality of the fusosomes.

179. The fusosome of any of the preceding embodiments, wherein the organellar protein payload agent comprises or encodes one or more of a basic helix-loop helix motif, leucine zipper motif, helix-turn-helix motif, homeodomain motif, a winged helix motif, a winged helix-turn motif, a HMG-box domain, a Wor3 domain, an OB-fold domain, a zinc finger motif, a TAL effector, or a B3 domain.

180. The fusosome of any of the preceding embodiments, wherein the organellar protein payload agent comprises or encodes a protein complex comprising a homodimer, a heterodimer, a homotrimer, a heterotrimer, a homotetramer, or a heterotetramer.

181. The fusosome of any of the preceding embodiments, wherein the organellar protein payload agent comprises or encodes a protein having a signal sequence which is the same as the signal sequence in a naturally-occurring counterpart of the protein. 182. The fusosome of any of the preceding embodiments, wherein the organellar protein payload agent comprises or encodes a protein having a signal sequence which is not comprised by a naturally-occurring counterpart of the protein.

183. The fusosome of any of the preceding embodiments, wherein the organellar protein payload agent comprises or encodes an antibody molecule, e.g., a Fab, an scFV, an scFab, a sdAb, a duobody, a minibody, a nanobody, a diabody, a zybody, a camelid antibody, a BiTE, a quadroma, or a bsDb.

184. The fusosome of any of the preceding embodiments, wherein the organellar payload agent comprises a functional RNA.

185. The fusosome of any of the preceding embodiments, wherein the organellar payload agent comprises an organellar protein payload agent, e.g., a protein or an mRNA encoding the protein.

186. The fusosome of any of the preceding embodiments, wherein the organellar payload agent does not comprise or encode a reporter protein or a fluorescent protein, e.g., GFP.

187. The fusosome of any of the preceding embodiments, wherein the lumen does not comprise an organelle.

188. The fusosome of any of the preceding embodiments, wherein the organellar protein payload agent, or protein encoded therein, is not a cell membrane protein or secreted protein.

189. The fusosome of any of the preceding embodiments, wherein the amount of viral capsid protein in the fusosome composition is less than 1% of total protein.

190. A fusosome comprising a chondrisome and a fusogen.

191. The fusosome of any of the preceding embodiments, which has partial or complete nuclear inactivation (e.g. nuclear removal).

192. The fusosome of any of the preceding embodiments, wherein the source cell is a cell grown under adherent or suspension conditions.

193. The fusosome of any of the preceding embodiments, wherein the source cell is a primary cell, a cultured cell, an immortalized cell, or a cell line (e.g., myelobast cell line, e.g., C2C12).

194. The fusosome of any of the preceding embodiments, wherein the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).

195. The fusosome of any of the preceding embodiments, wherein the source cell is allogeneic, e.g., obtained from a different organism of the same species as the target cell.

196. The fusosome of any of the preceding embodiments, wherein the source cell is autologous, e.g., obtained from the same organism as the target cell.

197. The fusosome of any of the preceding embodiments, wherein the source cell is heterologous, e.g., obtained from an organism of a different species from the target cell.

198. The fusosome of any of the preceding embodiments, wherein the source cell is selected from a white blood cell or a stem cell.

199. The fusosome of any of the preceding embodiments, wherein the source cell is selected from a neutrophil, a lymphocyte (e.g., a T cell, a B cell, a natural killer cell), a macrophage, a granulocyte, a mesenchymal stem cell, a bone marrow stem cell, an induced pluripotent stem cell, an embryonic stem cell, or a myeloblast.

200. The fusosome of any of the preceding embodiments, wherein the source cell is other than a 293 cell, HEK cell, human endothelial cell, or a human epithelial cell, monocyte, macrophage, dendritic cell, or stem cell.

201. The fusosome of any of the preceding embodiments, wherein:

i) the source cell is not transformed or immortalized; or ii) the source cell is transformed, or immortalized using a method other than adenovirus-mediated immortalization, e.g., immortalized by spontaneous mutation, or telomerase expression.

202. The fusosome of any of the preceding embodiments, wherein the fusosome is from a source cell having a modified genome, e.g., having reduced immunogenicity (e.g., by genome editing to remove MHC complexes).

203. The fusosome of any of the preceding embodiments, wherein the source cell is from a cell culture treated with an anti-inflammatory signal.

204. The fusosome of any of the preceding embodiments, wherein the source cell is substantially non-immunogenic, e.g., using an assay described herein.

205. The fusosome of any of the preceding embodiments, wherein the source cell is a recombinant cell.

206. The fusosome of any of the preceding embodiments, wherein the source cell comprises further comprises a second agent that is exogenous to the source cell, e.g., a therapeutic agent, e.g., a protein or a nucleic acid (e.g., an RNA, e.g., an mRNA or miRNA).

207. The fusosome of embodiment 206, wherein the second agent is present at least, or no more than, 10, 20, 50, 100, 200, 500, 1,000, 2,000, 5,000, 10,000, 20,000, 50,000, 100,000, 200,000, 500,000 or 1,000,000 copies comprised by the fusosome, or is present at an average level of at least, or no more than, 10, 20, 50, 100, 200, 500, 1,000, 2,000, 5,000, 10,000, 20,000, 50,000, 100, 000, 200,000, 500,000 or 1,000,000 copies per fusosome.

208. The fusosome of any of the preceding embodiments, wherein the fusosome has an altered, e.g., increased or decreased level of one or more endogenous molecules as compared to the source cell, e.g., protein or nucleic acid, e.g., due to treatment of the source cell, e.g., mammalian source cell with a siRNA or gene editing enzyme.

209. The fusosome of embodiment 208, wherein the fusosome comprises at least, or no more than, 10, 20, 50, 100, 200, 500, 1,000, 2,000, 5,000, 10,000, 20,000, 50,000, 100,000, 200,000, 500,000 or 1,000,000 copies of the endogenous molecule, or is present at an average level of at least, or no more than, 10, 20, 50, 100, 200, 500, 1,000, 2,000, 5,000, 10,000, 20,000, 50,000, 100, 000, 200,000, 500,000 or 1,000,000 copies of the endogenous molecule per fusosome.

210. The fusosome of embodiment 208 or embodiment 209, wherein the endogenous molecule (e.g., an RNA or protein) is present at a concentration of at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, $1.0\times10^7$, $5.0\times10^7$, or $1.0\times10^8$ greater than its concentration in the source cell.

211. The fusosome of embodiment 208 or embodiment 209, wherein the endogenous molecule (e.g., an RNA or protein) is present at a concentration of at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, $1.0\times10^7$, $5.0\times10^7$, or $1.0\times10^8$ less than its concentration in the source cell.

212. The fusosome of any of the preceding embodiments, wherein the fusosome has a miRNA content level of at least 1% than that of the source cell, e.g., by an assay of Example 39.

213. The fusosome of embodiment 206 or 207, wherein the second agent, e.g., therapeutic agent, is selected from a protein, protein complex (e.g., comprising at least 2, 3, 4, 5, 10, 20, or 50 proteins, e.g., at least at least 2, 3, 4, 5, 10, 20, or 50 different proteins) polypeptide, nucleic acid (e.g., DNA, chromosome, or RNA, e.g., mRNA, siRNA, or miRNA) or small molecule.

214. The fusosome of any of the preceding embodiments, wherein the fusosome comprises a proteomic composition similar to that of the source cell, e.g., using an assay of Example 42.

215. The fusosome of any of the preceding embodiments, wherein the fusosome has a soluble:non-soluble protein ratio within 90% of that of the source cell, e.g., by an assay of Example 47.

216. The fusosome of any of the preceding embodiments, which has a diameter that is less than about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% the size of the source cell, e.g., as measured by an assay of Example 30.

217. The fusosome of any of the preceding embodiments, wherein the fusosome has a diameter that is less than about 0.01% or 1%, of that of the source cell, e.g., as measured by an assay of Example 30.

218. The fusosome of any of the preceding embodiments, which has a volume that is less than about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90%% of the volume of the source cell.

219. The fusosome of any of the preceding embodiments, wherein the fusogen is a protein fusogen.

220. The fusosome of any of the preceding embodiments, wherein the fusogen is a mammalian fusogen or a viral fusogen.

221. The fusosome of any of the preceding embodiments, wherein the fusogen does not promote vesicle formation from a source cell.

222. The fusosome of any of the preceding embodiments, wherein the fusogen comprises an enucleated cell.

223. The fusosome of any of the preceding embodiments, wherein the fusogen:
  i) is other than a viral protein;
  ii) the fusogen is other than a fusogenic glycoprotein;
  iii) the fusogen is a mammalian protein other than fertilin-beta;
  iv) the fusogen is other than VSVG, a SNARE protein, or a secretory granule protein; or
  v) the fusogen is other than TAT, TAT-HA2, HA-2, gp41, Alzheimer's beta-amyloid peptide, a Sendai virus protein, or amphipathic net-negative peptide (WAE 11).

224. The fusosome of any of the preceding embodiments, wherein:
  i) the fusogen is present at a copy number of at least 1,000 copies, e.g., as measured by an assay of Example 29; or
  ii) the ratio of the copy number of the fusogen to the copy number of the payload (e.g., membrane payload agent, nuclear payload agent, or organellar payload agent) is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.

225. The fusosome of any of the preceding embodiments, wherein:
  i) the fusosome was not made by loading the fusosome with a therapeutic or diagnostic substance;
  ii) the source cell was not loaded with a therapeutic or diagnostic substance;
  iii) the fusosome does not comprise doxorubicin, dexamethasone, cyclodextrin; polyethylene glycol, a micro RNA e.g., miR125, VEGF receptor, ICAM-1, E-selectin, iron oxide, a fluorescent protein e.g., GFP or RFP, a nanoparticle, or an RNase, or does not comprise a form of any of the foregoing that is exogenous to the source cell; or
  iv) the fusosome further comprises a therapeutic agent that is exogenous to the source cell and comprises one or more post-translational modifications, e.g., glycosylation.

226. The fusosome of any of the preceding embodiments, wherein the fusogen is a viral fusogen, e.g., HA, HIV-1 ENV, gp120, or VSV-G, or wherein the fusogen is a mammalian fusogen, e.g., a SNARE, a Syncytin, myomaker, myomixer, myomerger, or FGFRL1.

227. The fusosome or fusosome of any of the preceding embodiments, wherein the fusogen is active at a pH of 4-5, 5-6, 6-7, 7-8, 8-9, or 9-10.

228. The fusosome of any of the preceding embodiments, wherein the fusogen is not active at a pH of 4-5, 5-6, 6-7, 7-8, 8-9, or 9-10.

229. The fusosome of any of the preceding embodiments wherein the fusogen is a lipid fusogen, e.g., oleic acid, glycerol mono-oleate, a glyceride, diacylglycerol, or a modified unsaturated fatty acid.

230. The fusosome of any of the preceding embodiments wherein the fusogen is a chemical fusogen, e.g., PEG.

231. The fusosome of any of the preceding embodiments wherein the fusogen is a small molecule fusogen, e.g., halothane, an NSAID such as meloxicam, piroxicam, tenoxicam, and chlorpromazine.

232. The fusosome of any of the preceding embodiments, wherein the fusogen is recombinant.

233. The fusosome of any of the preceding embodiments, wherein the fusogen is biochemically incorporated, e.g., the fusogen is provided as a purified protein and contacted with a fusosome lipid bilayer under conditions that allow for association of the fusogen with the lipid bilayer, or biosynthetically incorporated, e.g., expressed in a source cell under conditions that allow the fusogen to associate with the fusosome lipid bilayer.

234. The fusosome of any of the preceding embodiments, wherein the fusosome has one or more of the following properties:
  i) the fusosome comprises or is comprised by a cytobiologic;
  ii) the fusosome comprises or is comprised by an enucleated cell; or
  iii) the fusosome comprises an inactivated nucleus.

234A. The fusosome of any of the preceding embodiments, wherein the fusosome comprises a payload (e.g., a membrane payload agent, nuclear payload agent, or organellar payload agent) at a copy number of at least 1,000 copies, e.g., as measured by an assay of Example 43.

235. The fusosome of any of the preceding embodiments, wherein the fusosome has one or more of the following properties:
  i) the fusosome comprises a lipid wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;
  ii) the fusosome comprises a ratio of lipids to proteins that is within 10%, 20%, 30%, 40%, or 50% of the corresponding ratio in the source cell, e.g., as measured using an assay of Example 49;
  iii) the fusosome comprises a ratio of proteins to nucleic acids (e.g., DNA) that is within 10%, 20%, 30%, 40%, or 50% of the corresponding ratio in the source cell, e.g., as measured using an assay of Example 50; or
  iv) the fusosome comprises a ratio of lipids to nucleic acids (e.g., DNA) that is within 10%, 20%, 30%, 40%, or 50% of the corresponding ratio in the source cell, e.g., as measured using an assay of Example 51.

236. The fusosome of any of the preceding embodiments, wherein one or more of:

i) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90% (e.g., 10%), e.g., in an assay of Example 54;

ii) the fusosome fuses at a higher rate with a target cell than with other fusosomes, e.g., by at least 10%, 20%, 30%, 40%, 50%, 60%, 70%, 80%, or 90% (e.g., 50%), e.g., in an assay of Example 54;

iii) the fusosome fuses with target cells at a rate such that an agent in the fusosome is delivered to at least 10%, 20%, 30%, 40%, 50%, 60%, 70%, 80%, or 90% (e.g., 10%) of target cells after 24, 48, or 72 hours, e.g., in an assay of Example 54;

vi) the fusosome transports glucose (e.g., labeled glucose, e.g., 2-NBDG) across a membrane, e.g., by at least 10% more than a negative control, e.g., an otherwise similar fusosome in the absence of glucose, e.g., as measured using an assay of Example 64;

v) the fusosome comprises esterase activity in the lumen that is within 90% of that of the esterase activity in a reference cell, e.g., the source cell or a mouse embryonic fibroblast, e.g., using an assay of Example 66;

vi) the fusosome comprises a metabolic activity level that is within 90% of the metabolic activity (e.g., citrate synthase activity) in a reference cell, e.g., the source cell, e.g., as described in Example 68;

vii) the fusosome comprises a respiration level (e.g., oxygen consumption rate) that is within 90% of the respiration level in a reference cell, e.g., the source cell, e.g., as described in Example 69;

viii) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70;

ix) the fusosome has an LPS level less than 5% of the lipid content of fusosomes, e.g., as measured by an assay of Example 48;

x) the fusosome has juxtacrine-signaling level of at least 5% greater than the level of juxtacrine signaling induced by a reference cell, e.g., the source cell or a bone marrow stromal cell (BMSC), e.g., by an assay of Example 71;

xi) the fusosome has paracrine-signaling level of at least 5% greater than the level of paracrine signaling induced by a reference cell, e.g., the source cell or a macrophage, e.g., by an assay of Example 72;

xii) the fusosome polymerizes actin at a level within 5% compared to the level of polymerized actin in a reference cell, e.g., the source cell or a C2C12 cell, e.g., by the assay of Example 73; or xiii) the fusosome and/or compositions or preparations thereof, are capable of secreting a protein, e.g., at a rate at least 5% greater than a reference cell, e.g., a mouse embryonic fibroblast, e.g., using an assay of Example 62.

237. The fusosome of any of the preceding embodiments, wherein one or more of:

i) the fusosome has a membrane potential within about 5% of the membrane potential of a reference cell, e.g., the source cell or a C2C12 cell, e.g., by an assay of Example 74, or wherein the fusosome has a membrane potential of about −20 to ~150 mV, −20 to −50 mV, −50 to −100 mV, or −100 to −150 mV;

ii) the fusosome and/or compositions or preparations thereof, are capable of extravasation from blood vessels, e.g., at a rate at least 1%, 2%, 5%, 10%, 20%, 30%, 40%, 50%, 60%, 70%, 80%, or 90% the rate of extravasation of a cell of the same type as the source cell, e.g., using an assay of Example 57, e.g., wherein the source cell is a neutrophil, lymphocyte, B cell, macrophage, or NK cell;

iii) the fusosome and/or compositions or preparations thereof, are capable of crossing a cell membrane, e.g., an endothelial cell membrane or the blood brain barrier, e.g., at a rate at least 1%, 2%, 5%, 10%, 20%, 30%, 40%, 50%, 60%, 70%, 80%, or 90% that of a cell of the same type as the source cell;

iv) the fusosome meets a pharmaceutical or good manufacturing practices (GMP) standard;

v) the fusosome was made according to good manufacturing practices (GMP);

vi) the fusosome has a pathogen level below a predetermined reference value, e.g., is substantially free of pathogens;

vii) the fusosome has a contaminant level below a predetermined reference value, e.g., is substantially free of contaminants; or viii) the fusosome has low immunogenicity, e.g., as described herein.

238. The fusosome of any of the preceding embodiments, wherein the fusosome is or comprises a chondrisome.

239. The fusosome of any of the preceding embodiments, wherein the fusosome has a half-life in a subject, e.g., in a mouse, that is within 90% of the half-life of a reference cell, e.g., the source cell, e.g., by an assay of Example 75.

240. The fusosome preparation of any of the preceding embodiments, wherein:

i) the fusosome and/or compositions or preparations thereof has a density of other than between 1.08 g/mL and 1.12 g/mL;

ii) the fusosome and/or compositions or preparations thereof has a density of >1.12 g/mL, e.g., 1.25 g/mL+/−0.1, 1.25 g/mL+/−0.05, e.g., as measured by an assay of Example 33; or iii) the fusosome and/or compositions or preparations thereof has a density of <1, 1-1.1, 1.05-1.15, 1.1-1.2, 1.15-1.25, 1.2-1.3, 1.25-1.35, or >1.35 g/mL, e.g., by an assay of Example 33.

241. The fusosome of any of the preceding embodiments, wherein one or more of:

i) the fusosome is not captured by the scavenger system in circulation or by Kupffer cells in the sinus of the liver;

ii) the fusosome is not captured by the reticulo-endothelial system (RES) in a subject, e.g., by an assay of Example 76; or iii) when a plurality of fusosomes are administered to a subject, less than 1%, 2%, 3%, 4%, 5%, 10%, 20%, 30%, 40%, 50%, 60%, 70%, 80%, 90%, of the plurality are not captured by the RES after 24 hours, e.g., by an assay of Example 76.

242. The fusosome of any of the preceding embodiments, wherein:
i) the fusosome meets a pharmaceutical or good manufacturing practices (GMP) standard;
ii) the fusosome was made according to good manufacturing practices (GMP);
iii) the fusosome has a pathogen level below a predetermined reference value, e.g., is substantially free of pathogens; or
iv) the fusosome has a contaminant level below a predetermined reference value, e.g., is substantially free of contaminants.
243. The fusosome of any of the preceding embodiments, wherein:
i) the fusosome has a diameter of greater than 5 μm, 6 μm, 7 μm, 8 μm, 10 μm, 20 μm, 50 μm, 100 μm, 150 μm, or 200 μm.
ii) the fusosome has a diameter of other than between 40 and 150 nm, e.g., greater than 150 nm, 200 nm, 300 nm, 400 nm, or 500 nm;
iii) the fusosome has a diameter of at least 80 nm, 100 nm, 200 nm, 500 nm, 1000 nm, 1200 nm, 1400 nm, or 1500 nm;
iv) the fusosome has a diameter of less than 80 nm, 100 nm, 200 nm, 500 nm, 1000 nm, 1200 nm, 1400 nm, or 1500 nm; or
v) the fusosome has a diameter of at least about 10 nm, 20 nm, 30 nm, 40 nm, 50 nm, 60 nm, 70 nm, 80 nm, 90 nm, 100 nm, 150 nm, or 200 nm, e.g., as measured by an assay of Example 32.
244. The fusosome of any of the preceding embodiments, wherein the fusosome further comprises in its lumen a polypeptide selected from an enzyme, antibody, or anti-viral polypeptide.
245. The fusosome of any of the preceding embodiments, wherein the fusosome does not comprise CD63 or GLUT4.
246. The fusosome of any of the preceding embodiments, wherein the fusosome:
i) does not comprise a virus, is not infectious, or does not propagate in a host cell;
ii) is not a VLP (virus like particle);
iii) does not comprise a viral structural protein, e.g., a viral capsid protein, e.g., a viral nucleocapsid protein, or wherein the amount of viral capsid protein is less than 10%, 5%, 4%, 3%, 2%, 1%, 0.5%, 0.2%, or 0.1% of total protein, e.g., by an assay of Example 53;
iv) does not comprise a viral matrix protein;
v) does not comprise a viral non-structural protein;
vi) comprises less than 10, 50, 100, 500, 1,000, 2,000, 5,000, 10,000, 20,000, 50,000, 100,000, 200,000, 500,000, 1,000,000, 5,000,000, 10,000,000, 50,000, 000, 100,000,000, 500,000,000, 1,000,000,000 copies of a viral structural protein; or
vii) is not a virosome.
247. The fusosome of any of the preceding embodiments, wherein the fusosome comprises a viral structural protein and/or a viral matrix protein.
248. The fusosome of any of the preceding embodiments, wherein:
i) the ratio of the copy number of the fusogen to the copy number of viral structural protein on the fusosome is at least 1,000,000:1, 100,000:1, 10,000:1, 1,000:1, 100:1, 50:1 1, 20:1, 10:1, 5:1, or 1:1;
ii) the ratio of the copy number of the fusogen to the copy number of viral matrix protein on the fusosome is at least 1,000,000:1, 100,000:1, 10,000:1, 1,000:1, 100:1, 50:1, 20:1, 10:1, 5:1, or 1:1.
249. The fusosome of any of the preceding embodiments, wherein the fusosome is unilamellar or multilamellar.
250. The fusosome of any of the preceding embodiments, wherein:
i) the fusosome does not comprise a water-immiscible droplet;
ii) the fusosome comprises an aqueous lumen and a hydrophilic exterior.
251. The fusosome of any of the preceding embodiments, wherein the fusosome is substantially free of one or more of the following organelles: a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule.
252. The fusosome of any of the preceding embodiments, wherein the fusosome has a lower number of an organelle as compared to the source cell, where the organelle is selected from: a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule.
253. The fusosome of any of the preceding embodiments, wherein:
i) the fusosome is not an exosome;
ii) the fusosome is a microvesicle;
iii) the fusosome comprises a non-mammalian fusogen;
iv) the fusosome has been engineered to incorporate a fusogen;
v) the fusosome comprises a fusogen that is exogenous to the source cell;
vi) the fusosome comprises one or more organelles, e.g., a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, stress granule, or a combination thereof;
vii) the fusosome comprises a cytoskeleton or a component thereof, e.g., actin, Arp2/3, formin, coronin, dystrophin, keratin, myosin, or tubulin;
viii) the fusosome and/or compositions or preparations thereof does not have a flotation density of 1.08-1.22 g/mL, or has a density of at least 1.18-1.25 g/mL, or 1.05-1.12 g/mL, e.g., in a sucrose gradient centrifugation assay, e.g., as described in Thèry et al., "Isolation and characterization of exosomes from cell culture supernatants and biological fluids." Curr Protoc Cell Biol. 2006 April; Chapter 3:Unit 3.22;
ix) the fusosome lipid bilayer is enriched for ceramides or sphingomyelins or a combination thereof compared to the source cell, or the fusosome lipid bilayer is not enriched (e.g., is depleted) for glycolipids, free fatty acids, or phosphatidylserine, or a combination thereof, compared to the source cell;
x) the fusosome comprises Phosphatidyl serine (PS) or CD40 ligand or both of PS and CD40 ligand, e.g., when measured in an assay of Example 52;
xi) the fusosome is enriched for PS compared to the source cell, e.g., in a plurality of fusosomes at least 5%, 10% 20%, 30%, 40%, 50%, 60%, 70%, 80%, or 90% are positive for PS;

xii) the fusosome is substantially free of acetylcholinesterase (AChE), or contains less than 0.001, 0.002, 0.005, 0.01, 0.02, 0.05, 0.1, 0.2, 0.5, 1, 2, 5, 10, 20, 50, 100, 200, 500, or 1000 AChE activity units/μg of protein, e.g., by an assay of Example 67;

xiii) the fusosome is substantially free of a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, or contains less than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is de-enriched for any one or more of these proteins compared to the source cell, or is not enriched for any one or more of these proteins, e.g., by an assay of Example 44;

xiv) the fusosome comprises a level of Glyceraldehyde 3-phosphate dehydrogenase (GAPDH) that is below 500, 250, 100, 50, 20, 10, 5, or 1 ng GAPDH/μg total protein or below the level of GAPDH in the source cell, e.g., less than 1%, 2.5%, 5%, 10%, 15%, 20%, 30%, 40%, 50%, 60%, 70%, 80%, or 90%, less than the level of GAPDH per total protein in ng/μg in the source cell, e.g., using an assay of Example 45;

xv) the fusosome is enriched for one or more endoplasmic reticulum proteins (e.g., calnexin), one or more proteasome proteins, or one or more mitochondrial proteins, or any combination thereof, e.g., wherein the amount of calnexin is greater than 500, 250, 100, 50, 20, 10, 5, or 1 ng Calnexin/μg total protein, or wherein the fusosome comprises more Calnexin per total protein in ng/μg compared to the source cell by 1%, 2.5%, 5%, 10%, 15%, 20%, 30%, 40%, 50%, 60%, 70%, 80%, or 90%, e.g., using an assay of Example 46;

xvi) the fusosome comprises an agent that is exogenous to the source cell (e.g., protein, mRNA, or siRNA) e.g., as measured using an assay of Example 39 or 40; or xvii) the fusosome can be immobilized on a mica surface by atomic force microscopy for at least 30 min.

254. The fusosome of any of the preceding embodiments, wherein:

i) the fusosome is an exosome;

ii) the fusosome is not a microvesicle;

iii) the fusosome does not comprise an organelle;

iv) the fusosome does not comprise a cytoskeleton or a component thereof, e.g., actin, Arp2/3, formin, coronin, dystrophin, keratin, myosin, or tubulin;

v) the fusosome and/or compositions or preparations thereof has flotation density of 1.08-1.22 g/mL, e.g., in a sucrose gradient centrifugation assay;

vi) the fusosome lipid bilayer is not enriched (e.g., is depleted) for ceramides or sphingomyelins or a combination thereof compared to the source cell, or the fusosome lipid bilayer is enriched for glycolipids, free fatty acids, or phosphatidylserine, or a combination thereof, compared to the source cell;

vii) the fusosome does not comprise, or is depleted for relative to the source cell, Phosphatidyl serine (PS) or CD40 ligand or both of PS and CD40 ligand, e.g., when measured in an assay of Example 52;

viii) the fusosome is not enriched (e.g., is depleted) for PS compared to the source cell, e.g., in a plurality of fusosomes less than 20%, 30%, 40%, 50%, 60%, 70%, 80%, or 90% are positive for PS;

ix) the fusosome comprises acetylcholinesterase (AChE), e.g. at least 0.001, 0.002, 0.005, 0.01, 0.02, 0.05, 0.1, 0.2, 0.5, 1, 2, 5, 10, 20, 50, 100, 200, 500, or 1000 AChE activity units/μg of protein, e.g., by an assay of Example 67;

x) the fusosome comprises a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, e.g., contains more than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is enriched for any one or more of these proteins compared to the source cell, e.g., by an assay of Example 44;

xi) the fusosome comprises a level of Glyceraldehyde 3-phosphate dehydrogenase (GAPDH) that is above 500, 250, 100, 50, 20, 10, 5, or 1 ng GAPDH/μg total protein or below the level of GAPDH in the source cell, e.g., at least 1%, 2.5%, 5%, 10%, 15%, 20%, 30%, 40%, 50%, 60%, 70%, 80%, or 90%, greater than the level of GAPDH per total protein in ng/μg in the source cell, e.g., using an assay of Example 45;

xii) the fusosome is not enriched for (e.g., is depleted for) one or more endoplasmic reticulum proteins (e.g., calnexin), one or more proteasome proteins, or one or more mitochondrial proteins, or any combination thereof, e.g., wherein the amount of calnexin is less than 500, 250, 100, 50, 20, 10, 5, or 1 ng Calnexin/μg total protein, or wherein the fusosome comprises less Calnexin per total protein in ng/μg compared to the source cell by 1%, 2.5%, 5%, 10%, 15%, 20%, 30%, 40%, 50%, 60%, 70%, 80%, or 90%, e.g., using an assay of Example 46; or xiii) the fusosome cannot be immobilized on a mica surface by atomic force microscopy for at least 30 min.

255. The fusosome of any of the preceding embodiments, wherein:

i) the fusosome does not comprise a VLP;

ii) the fusosome does not comprise a virus;

iii) the fusosome does not comprise a replication-competent virus;

iv) the fusosome does not comprise a viral protein, e.g., a viral structural protein, e.g., a capsid protein or a viral matrix protein;

v) the fusosome does not comprise a capsid protein from an enveloped virus;

vi) the fusosome does not comprise a nucleocapsid protein; or vii) the fusogen is not a viral fusogen.

256. The fusosome of any of the preceding embodiments, wherein the fusosome comprises cytosol.

257. The fusosome of any of the preceding embodiments, wherein:

i) the fusosome does not form a teratoma when implanted into subject, e.g., by an assay of Example 102;

ii) the fusosome and/or compositions or preparations thereof, are capable of chemotaxis, e.g., at a speed at least 1%, 2%, 3%, 4%, 5%, 10%, 20%, 30%, 40%, 50%, 60%, 70%, 80%, 90%, 100% compared to a reference cell, e.g., a macrophage, e.g., using an assay of Example 58;

iii) the fusosome and/or compositions or preparations thereof, are capable of homing, e.g., at the site of an injury, wherein the fusosome is from a human cell, e.g., using an assay of Example 59, e.g., wherein the source cell is a neutrophil; or iv) the fusosome and/or compositions or preparations thereof, are capable of phagocytosis, e.g., wherein phagocytosis by the fusosome is detectable within 0.5, 1, 2, 3, 4, 5, or 6 hours in using an assay of Example 60, e.g., wherein the source cell is a macrophage.

258. The fusosome of any of the preceding embodiments, wherein the fusosome has one or more of the following characteristics:

a) comprises one or more endogenous proteins from a source cell, e.g., membrane proteins or cytosolic proteins;

b) comprises at least 10, 20, 50, 100, 200, 500, 1000, 2000, or 5000 different proteins;

c) comprises at least 1, 2, 5, 10, 20, 50, or 100 different glycoproteins;

d) at least 10%, 20%, 30%, 40%, 50%, 60%, 70%, 80%, or 90% by mass of the proteins in the fusosome are naturally-occurring proteins;

e) comprises at least 10, 20, 50, 100, 200, 500, 1000, 2000, or 5000 different RNAs; or f) comprises at least 2, 3, 4, 5, 10, or 20 different lipids, e.g., selected from CL, Cer, DAG, HexCer, LPA, LPC, LPE, LPG, LPI, LPS, PA, PC, PE, PG, PI, PS, CE, SM and TAG.

259. The fusosome of any of the preceding embodiments, wherein the fusosome has been manipulated to have, or wherein the fusosome is not a naturally occurring cell and has, or wherein the nucleus is not naturally one, two, three, four, five or more of the following properties:

i) the partial nuclear inactivation results in a reduction of at least 50%, 60%, 70%, 80%, 90% or more in nuclear function, e.g., a reduction in transcription or DNA replication, or both, e.g., wherein transcription is measured by an assay of Example 19 and DNA replication is measured by an assay of Example 20;

ii) the fusosome is not capable of transcription or has transcriptional activity of less than 1%, 2.5%, 5%, 10%, 20%, 30%, 40%, 50%, 60%, 70%, 80%, or 90% of that of the transcriptional activity of a reference cell, e.g., the source cell, e.g., using an assay of Example 19;

iii) the fusosome is not capable of nuclear DNA replication or has nuclear DNA replication of less than 1%, 2.5% 5%, 10%, 20%, 30%, 40%, 50%, 60%, 70%, 80%, or 90% of the nuclear DNA replication of a reference cell, e.g., the source cell, e.g., using an assay of Example 20;

iv) the fusosome lacks chromatin or has a chromatin content of less than 1%, 2.5% 5%, 10%, 20%, 30%, 40%, 50%, 60%, 70%, 80%, or 90% of the of the chromatin content of a reference cell, e.g., the source cell, e.g., using an assay of Example 37;

v) the fusosome lacks a nuclear membrane or has less than 50%, 40%, 30%, 20%, 10%, 5%, 4%, 3%, 2%, or 1% the amount of nuclear membrane of a reference cell, e.g., the source cell or a Jurkat cell, e.g., by an assay of Example 36;

vi) the fusosome lacks functional nuclear pore complexes or has reduced nuclear import or export activity, e.g., by at least 50%, 40%, 30%, 20%, 10%, 5%, 4%, 3%, 2%, or 1% by an assay of Example 36, or the fusosome lacks on or more of a nuclear pore protein, e.g., NUP98 or Importin 7;

vii) the fusosome does not comprise histones or has histone levels less than 1%, of the histone level of the source cell (e.g., of H1, H2a, H2b, H3, or H4), e.g., by an assay of Example 37;

viii) the fusosome comprises less than 20, 10, 5, 4, 3, 2, or 1 chromosome;

ix) nuclear function is eliminated;

x) the fusosome is an enucleated mammalian cell;

xi) the nucleus is removed or inactivated, e.g., extruded by mechanical force, by radiation or by chemical ablation; or xii) the fusosome is from a mammalian cell having DNA that is completely or partially removed, e.g., during interphase or mitosis.

260. The fusosome of any of the preceding embodiments, wherein the fusosome comprises mtDNA or vector DNA.

261. The fusosome of any of the preceding embodiments, which does not comprise DNA or is substantially free of DNA.

262. The fusosome of any of the preceding embodiments, wherein the fusosome does not comprise a functional nucleus.

263. The fusosome of any of the preceding embodiments, wherein the fusosome does not comprise a nucleus.

264. The fusosome of any of the preceding embodiments, wherein the fusosome is substantially free of nuclear DNA.

265. The fusosome of any of the preceding embodiments, wherein:

ii) the fusosome does not comprise Cre or GFP, e.g., EGFP; or iii) the fusosome further comprises a protein that is exogenous to the source cell and is other than Cre or GFP, e.g., EGFP.

266. The fusosome of any of the preceding embodiments, wherein the fusosome further comprises a nucleic acid (e.g., a DNA, a gDNA, a cDNA, an RNA, a pre-mRNA, an mRNA, an miRNA, or an siRNA) or protein (e.g., an antibody), wherein the nucleic acid or protein is exogenous to the source cell, e.g., in the lumen.

267. The fusosome of any of the preceding embodiments, wherein the fusosome does not comprise mitochondria or is substantially free of mitochondria.

268. The fusosome of any of the preceding embodiments, which retains one, two, three, four, five six or more of any of the characteristics for 5 days or less, e.g., 4 days or less, 3 days or less, 2 days or less, 1 day or less, e.g., about 12-72 hours, after administration into a subject, e.g., a human subject.

269. The fusosome of any of the preceding embodiments, which associates with and/or binds a target cell or a surface feature of a target cell.

270. The fusosome of any of the preceding embodiments, which fuses to the target cell at the surface of the target cell.

271. The fusosome of any of the preceding embodiments, which promotes fusion to a target cell in a lysosome-independent manner.
272. The fusosome of any of the preceding embodiments, wherein the fusosome and/or fusosome contents enters the target cell by endocytosis or via a non-endocytic pathway.
273. The fusosome of any of the preceding embodiments, wherein at least a portion of the fusosome lipid bilayer becomes incorporated in the target cell membrane.
274. The fusosome of embodiment 273, wherein the fusosome enters the target cell by endocytosis, e.g., wherein the level of payload (e.g., membrane payload agent, nuclear payload agent, or organellar payload agent) delivered via an endocytic pathway for a given fusosome is 0.01-0.6, 0.01-0.1, 0.1-0.3, or 0.3-0.6, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 91.
275. The fusosome of embodiment 273, wherein the fusosome enters the target cell by a non-endocytic pathway, e.g., wherein the level of payload (e.g., membrane payload agent, nuclear payload agent, or organellar payload agent) delivered via a non-endocytic pathway for a given fusosome is 0.1-0.95, 0.1-0.2, 0.2-0.3, 0.3-0.4, 0.4-0.5, 0.5-0.6, 0.6-0.7, 0.7-0.8, 0.8-0.9, 0.9-0.95, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 90.
276. The fusosome of any of the preceding embodiments, wherein the target cell is in an organism.
277. The fusosome of any of the preceding embodiments, wherein the target cell is a primary cell isolated from an organism.
278. The fusosome of any of the preceding embodiments, wherein the target cell is selected from an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).
279. The fusosome of any of the preceding embodiments, wherein the target cell is other than a HeLa cell, or the target cell is not transformed or immortalized.
280. The fusosome of any of the preceding embodiments, wherein the target cell is transformed or immortalized.
281. The fusosome of any of the preceding embodiments, wherein the target cell is selected from a white blood cell or a stem cell.
282. The fusosome of any of the preceding embodiments, wherein the target cell is selected from a neutrophil, a lymphocyte (e.g., a T cell, a B cell, a natural killer cell), a macrophage, a granulocyte, a mesenchymal stem cell, a bone marrow stem cell, an induced pluripotent stem cell, an embryonic stem cell, or a myeloblast.
283. The fusosome of any of the preceding embodiments, wherein the fusosome comprises a targeting domain which localizes the fusosome to a target cell.
284. The fusosome of embodiment 283, wherein the targeting domain interacts with a target cell moiety on the target cell.
285. The fusosome of embodiment 284, wherein the target cell moiety is a cell surface feature.
286. The fusosome of embodiment 284 or embodiment 285, wherein the fusosome does not comprise said target cell moiety.
287. The fusosome of any of the preceding embodiments, wherein the fusosome comprises a fusogen which interacts with a fusogen binding partner on the target cell, thereby allowing the fusosome to bind or fuse to the target cell.
288. The fusosome of embodiment 287, wherein the fusosome does not comprise said fusogen binding partner.
289. The fusosome of any of embodiments 283-288, wherein the targeting domain is not part of the fusogen.
290. The fusosome of any of embodiments 283-288, wherein the fusogen comprises the targeting domain.
291. The fusosome of any of embodiments 283-289, wherein the fusogen binding partner is or is a portion of a different entity from the target cell moiety.
292. The fusosome of any of embodiments 283-289, wherein the fusogen binding partner is or is a portion of the target cell moiety.
293. The fusosome of any of the preceding embodiments, further comprising an organelle, e.g., a therapeutically effective number of organelles, disposed in the lumen.
294. The fusosome of any of the preceding embodiments, wherein:
i) the source cell is other than a dendritic cell or tumor cell, e.g., the source cell is selected from an endothelial cell, a macrophage, a neutrophil, a granulocyte, a leukocyte, a stem cell (e.g., a mesenchymal stem cell, a bone marrow stem cell, an induced pluripotent stem cell, an embryonic stem cell), a myeloblast, a myoblast, a hepatocyte, or a neuron e.g., retinal neuronal cell;
ii) the fusogen is other than a fusogenic glycoprotein;
iii) the fusogen is a mammalian protein other than fertilin-beta;
iv) the fusosome has low immunogenicity, e.g., as described herein;
v) the fusosome meets a pharmaceutical or good manufacturing practices (GMP) standard;
vi) a pharmaceutical preparation comprising a plurality of the fusosomes was made according to good manufacturing practices (GMP);
vii) a pharmaceutical preparation comprising a plurality of the fusosomes has a pathogen level below a predetermined reference value, e.g., is substantially free of pathogens; or viii) a pharmaceutical preparation comprising a plurality of the fusosomes has a contaminant level below a predetermined reference value, e.g., is substantially free of contaminants.

295. A fusosome composition or fusosome preparation, comprising a plurality of fusosomes according to any of the preceding embodiments.

296. A fusosome composition comprising a plurality of fusosomes, wherein at least one fusosome comprises:

(a) a lipid bilayer comprising a plurality of lipids derived from a source cell;

(b) a lumen (e.g., comprising cytosol) surrounded by the lipid bilayer;

(c) a fusogen that is exogenous or overexpressed relative to the source cell, e.g., wherein the fusogen is disposed in the lipid bilayer;

(d) a payload (e.g., a membrane payload agent, nuclear payload agent, or organellar payload agent), e.g., membrane protein payload agent, nuclear protein payload agent, or organellar protein payload agent, e.g., as described herein.

297. The fusosome composition of embodiment 295 or embodiment 296, where at least one fusosome of the plurality of fusosomes is derived from a source cell.

298. The fusosome composition of any of embodiments 295-297, wherein the fusosome is at a temperature of less than 4, 0, −4, −10, −12, −16, −20, −80, or −160° C.

299. The fusosome composition of any of embodiments 295-298, wherein the plurality of fusosomes comprises at least about $10^3$, $10^4$, $10^5$, $10^6$, $10^7$, $10^8$, $10^9$, $10^{10}$, $10^{11}$, $10^{12}$, $10^{13}$, $10^{14}$, or $10^{15}$ fusosomes.

300. The fusosome composition of any of embodiments 295-299, wherein the plurality of fusosomes are the same.

301. The fusosome composition of embodiment 300, wherein the plurality of fusosomes are the same if at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of the fusosomes in the fusosome composition share at least one property selected from:

comprise the same fusogen;

produced using the same type of source cell; or comprise the same payload (e.g., a membrane payload agent, nuclear payload agent, or organellar payload agent).

302. The fusosome composition of any of embodiments 295-299, wherein the plurality of fusosomes are different.

303. The fusosome composition of any of embodiments 295-302, wherein the plurality of fusosomes is derived from two or more types of source cells.

304. The fusosome composition of any of embodiments 295-303, which has a volume of at least 1 μL, 2 μL. 5 μL, 10 μL, 20 μL, 50 μL, 100 μL, 200 μL, 500 μL, 1 mL, 2 mL, 5 mL, or 10 mL.

305. The fusosome composition of any of embodiments 295-304, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise a functional nucleus.

306. The fusosome composition of any of embodiments 295-305, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise a nucleus.

307. The fusosome composition of any of embodiments 295-306, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which are substantially free of nuclear DNA.

308. The fusosome composition of any of embodiments 295-307, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise functional mitochondria.

309. The fusosome composition of any of embodiments 295-308, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which do not comprise mitochondria.

310. The fusosome composition of any of embodiments 295-309, which comprises less than 0.01%, 0.05%, 0.1%, 0.5%, 1%, 1.5%, 2%, 2.5%, 3%, 4%, 5%, or 10% source cells by protein mass or less than 0.01%, 0.05%, 0.1%, 0.5%, 1%, 1.5%, 2%, 2.5%, 3%, 4%, 5%, or 10% of source cells having a functional nucleus.

311. The fusosome composition of any of embodiments 295-310, wherein the fusosome composition comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes wherein:

i) the fusogen is present at a copy number of at least 1,000 copies per fusosome, e.g., as measured by an assay of Example 29; or ii) the ratio of the copy number of the fusogen to the copy number of the payload (e.g., a membrane payload agent, nuclear payload agent, or organellar payload agent) per fusosome is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.

312. The fusosome composition of any of embodiments 295-311, wherein the fusosome composition comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes wherein the payload (e.g., a membrane payload agent, nuclear payload agent, or organellar payload agent) is present at a copy number of at least 1,000 copies per fusosome, e.g., as measured by an assay of Example 43.

313. The fusosome composition of any of embodiments 295-312, wherein the plurality of fusosomes has a mean diameter of at least about 50 nm, about 80 nm, about 100 nm, about 200 nm, about 500 nm, about 1000 nm, about 1200 nm, about 1400 nm, or about 1500 nm.

314. The fusosome composition of any of embodiments 295-313, wherein the plurality of fusosomes comprises fusosomes having a diameter within the range of about 10 nm to about 100 μm.
315. The fusosome composition of any of embodiments 295-314, wherein the plurality comprises fusosomes having a size within the range of about 20 nm to about 200 nm, about 50 nm to about 200 nm, about 50 nm to about 100 nm, about 50 nm to about 150 nm, or about 100 nm to about 150 nm.
316. The fusosome composition of any of embodiments 295-315, wherein at least 50% of fusosomes in the plurality have a diameter within 10%, 20%, 30%, 40%, or 50% of the mean diameter of the fusosomes in the fusosome composition. 317. The fusosome composition of any of embodiments 295-316, wherein the plurality comprises fusosomes having a volume within the range of about 500 $nm^3$ to about 0.0006 $mm^3$, or about 4,000 $nm^3$ to about 0.005 $\mu m^3$, about 65,000 $nm^3$ to about 0.005 $\mu m^3$, about 65,000 $nm^3$ to about 0.0006 $\mu m^3$, about 65,000 $nm^3$ to about 0.002 $\mu m^3$, or about 0.0006 $\mu m^3$ to about 0.002 $\mu m^3$.
318. The fusosome composition of any of embodiments 295-317, wherein at least 50% of fusosomes in the plurality have a volume within 10%, 20%, 30%, 40%, or 50% of the mean volume of the fusosomes in the fusosome composition.
319. The fusosome composition of any of embodiments 295-318, wherein at least 50% of fusosomes in the plurality have a copy number of the fusogen within 10%, 20%, 30%, 40%, or 50% of the mean fusogen copy number in the fusosomes in the fusosome composition.
320. The fusosome composition of any of embodiments 295-319, wherein at least 50% of fusosomes in the plurality have a copy number of the payload (e.g., a membrane payload agent, nuclear payload agent, or organellar payload agent) within 10%, 20%, 30%, 40%, or 50% of the mean payload (e.g., a membrane payload agent, nuclear payload agent, or organellar payload agent) copy number in the fusosomes in the fusosome composition.
321. The fusosome composition of any of the preceding embodiments, wherein less than 10%, 5%, 4%, 3%, 2%, or 1% of fusosomes in the composition comprise an organelle in the lumen, e.g., the lumen does not comprise one or more of a mitochondrion, Golgi apparatus, lysosome, endoplasmic reticulum, mitochondria, vacuole, endosome, acrosome, autophagosome, centriole, glycosome, glyoxysome, hydrogenosome, melanosome, mitosome, cnidocyst, peroxisome, proteasome, vesicle, or stress granule.
322. A pharmaceutical composition comprising the fusosome composition or preparation of any of the preceding embodiments and a pharmaceutically acceptable carrier.
323. The fusosome composition or pharmaceutical composition of any of the preceding embodiments, which has been maintained at a predetermined temperature for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.
324. The fusosome composition or pharmaceutical composition of embodiment 323, wherein the predetermined temperature is selected from about 4, 0, −4, −10, −12, −16, −20, −80, or −160° C.
325. The fusosome composition or pharmaceutical composition of embodiment 323 or embodiment 324, which has an activity of at least 50%, 60%, 70%, 80%, 90%, 95%, or 99% of the activity of the plurality before maintenance at said temperature, e.g., by one or more of:
 i) the fusosome fuses at a higher rate with a target cell than with a non-target cell, e.g., by at least at least 10%, e.g., in an assay of Example 54;
 ii) the fusosome fuses at a higher rate with a target cell than with other fusosomes, e.g., by at least 50%, e.g., in an assay of Example 54;
 iii) the fusosome fuses with target cells at a rate such that an agent in the fusosome is delivered to at least 10% of target cells after 24 hours, e.g., in an assay of Example 54; or iv) the fusogen is present at a copy number of at least 50%, 60%, 70%, 80%, 90%, 95%, or 99% of the fusogen copy number of the plurality before maintenance at said temperature, e.g., as measured by an assay of Example 29.
326. The fusosome composition or pharmaceutical composition of any of the preceding embodiments, which is stable on storage at a temperature of less than 4° C. for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.
327. The fusosome composition or pharmaceutical composition of any of the preceding embodiments, which is stable on storage at a temperature of less than −20° C. for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.
328. The fusosome composition or pharmaceutical composition of any of the preceding embodiments, which is stable on storage at a temperature of less than −80° C. for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.
329. The fusosome composition or pharmaceutical composition of any of embodiments 326-328, wherein the composition is considered stable if it has an activity of at least 50%, 60%, 70%, 80%, 90%, 95%, or 99% of the activity of the plurality before storage at said temperature for said time period, e.g., by one or more of:
 i) the fusosome fuses at a higher rate with a target cell than with a non-target cell, e.g., by at least at least 10%, e.g., in an assay of Example 54;
 ii) the fusosome fuses at a higher rate with a target cell than with other fusosomes, e.g., by at least 50%, e.g., in an assay of Example 54;
 iii) the fusosome fuses with target cells at a rate such that an agent in the fusosome is delivered to at least 10% of target cells after 24 hours, e.g., in an assay of Example 54; or
 iv) the fusogen is present at a copy number of at least 50%, 60%, 70%, 80%, 90%, 95%, or 99% of the fusogen copy number of the plurality before maintenance at said temperature, e.g., as measured by an assay of Example 29.
330. The pharmaceutical composition of any of embodiments 322-329, having one or more of the following characteristics:
 a) the pharmaceutical composition meets a pharmaceutical or good manufacturing practices (GMP) standard;
 b) the pharmaceutical composition was made according to good manufacturing practices (GMP);

c) the pharmaceutical composition has a pathogen level below a predetermined reference value, e.g., is substantially free of pathogens;
d) the pharmaceutical composition has a contaminant level below a predetermined reference value, e.g., is substantially free of contaminants; or
e) the pharmaceutical composition has low immunogenicity, e.g., as described herein.

331. A method of manufacturing a fusosome composition, comprising:
a) providing a source cell comprising, e.g., expressing, a fusogen;
b) producing a fusosome from the source cell, wherein the fusosome comprises a lipid bilayer, a lumen, a fusogen, and a payload (e.g., a membrane payload agent, nuclear payload agent, or organellar payload agent), e.g., membrane protein payload agent, nuclear protein payload agent, or organellar protein payload agent, thereby making a fusosome; and
c) formulating the fusosome, e.g., as a pharmaceutical composition suitable for administration to a subject, wherein one or more of:
xii) the source cell is other than a 293 cell, HEK cell, human endothelial cell, or a human epithelial cell;
xiii) the fusogen is other than a viral protein;
xiv) the fusosome and/or compositions or preparations thereof has a density of other than between 1.08 g/mL and 1.12 g/mL, e.g.,
xv) the fusosome and/or compositions or preparations thereof has a density of 1.25 g/mL+/−0.05, e.g., as measured by an assay of Example 33;
xvi) the fusosome is not captured by the scavenger system in circulation or by Kupffer cells in the sinus of the liver; xvii) the fusosome is not captured by the reticulo-endothelial system (RES) in a subject, e.g., by an assay of Example 76;
xviii) when a plurality of fusosomes are administered to a subject, less than 1%, 2%, 3%, 4%, 5%, 10%, 20%, 30%, 40%, 50%, 60%, 70%, 80%, 90%, of the plurality are not captured by the RES after 24 hours, e.g., by an assay of Example 76;
xix) the fusosome has a diameter of greater than 5 μm, 6 μm, 7 μm, 8 μm, 10 μm, 20 μm, 50 μm, 100 μm, 150 μm, or 200 μm.
xx) the fusosome comprises a cytobiologic;
xxi) the fusosome comprises an enucleated cell; or
xxii) the fusosome comprises an inactivated nucleus.

332. The method of embodiment 331, wherein providing a source cell expressing a fusogen comprises expressing an exogenous fusogen in the source cell or upregulating expression of an endogenous fusogen in the source cell.

333. The method of embodiment 331 or embodiment 332, which comprises inactivating the nucleus of the source cell.

334. A method of manufacturing a fusosome composition, comprising:
i) providing a plurality of fusosomes according to any of embodiments 1-70, a fusosome composition of any of embodiments 71-97, or a pharmaceutical composition of embodiment 97; and
ii) formulating the plurality of fusosomes, fusosome composition, or pharmaceutical composition, e.g., as a fusosome drug product suitable for administration to a subject.

335. The method of any of embodiments 331-334, wherein the fusosome composition comprises at least $10^3$, $10^4$, $10^5$, $10^6$, $10^7$, $10^8$, $10^9$, $10^{10}$, $10^{11}$, $10^{12}$, $10^{13}$, $10^{14}$, or $10^{15}$ fusosomes.

336. The method of any of embodiments 331-335, wherein the fusosome composition comprises a volume of at least 10 mL, 20 mL, 50 mL, 100 mL, 200 mL, 500 mL, 1 L, 2 L, 5 L, 10 L, 20 L, or 50 L.

337. The method of any of embodiments 331-336, which comprises enucleating the source cell, e.g., mammalian cell, e.g., by chemical enucleation, use of mechanical force e.g. use of a filter or centrifuge, least partial disruption of the cytoskeleton.

338. The method of any of embodiments 331-337, which comprises expressing a fusogen or other membrane protein in the source cell.

339. The method of any of embodiments 331-338, which comprises one or more of: vesiculation, hypotonic treatment, extrusion, or centrifugation.

340. The method of any of embodiments 331-339, which comprises genetically expressing an exogenous agent in the cell or loading the exogenous agent into the source cell or fusosome.

341. The method of any of embodiments 331-340, which comprises contacting the source cell with DNA encoding a polypeptide agent, e.g., before inactivating the nucleus, e.g., enucleating the source cell.

342. The method of any of embodiments 331-341, which comprises contacting the source cell with RNA encoding a polypeptide agent, e.g., before or after inactivating the nucleus, e.g., enucleating the source cell.

343. The method of any of embodiments 331-342, which comprises introducing a payload, e.g., a membrane payload agent, nuclear payload agent, or organellar payload agent (e.g., a nucleic acid or protein), into a fusosome, e.g., by electroporation.

344. The method of any of embodiments 331-343 wherein the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).

345. The method of any of embodiments 331-344, wherein the fusosome is from a mammalian cell having a modified genome, e.g., having reduced immunogenicity (e.g., by genome editing to remove MHC complexes).

346. The method of any of embodiments 331-345, wherein the source cell is from a cell culture treated with an anti-inflammatory signal.

347. The method of any of embodiments 331-346, further comprising contacting the source cell of step a) with an anti-inflammatory signal, e.g., before or after inactivating the nucleus, e.g., enucleating the cell.

348. A method of manufacturing a fusosome drug product composition, comprising:

a) providing, e.g., producing, a plurality of fusosomes according to any of embodiments 1-70, a fusosome composition of any of embodiments 71-97, or a pharmaceutical composition of embodiment 97; and b) assaying one or more fusosomes from the plurality to determine whether one or more (e.g., 2, 3, or all) of the following standards are met:

i) the fusosome fuses at a higher rate with a target cell than with a non-target cell, e.g., by at least at least 10% e.g., in an assay of Example 54;

ii) the fusosome fuses at a higher rate with a target cell than with other fusosomes, e.g., by at least 50% e.g., in an assay of Example 54;

iii) the fusosome fuses with target cells at a rate such that an agent in the fusosome is delivered to at least 10% of target cells after 24 hours, e.g., in an assay of Example 54;

iv) the fusogen is present at a copy number of at least 1,000 copies, e.g., as measured by an assay of Example 29;

v) the fusosome comprises a payload (e.g., membrane payload agent, nuclear payload agent, or organellar payload agent) at a copy number of at least 1,000 copies, e.g., as measured by an assay of Example 43;

vi) the ratio of the copy number of the fusogen to the copy number of the payload (e.g., membrane payload agent, nuclear payload agent, or organellar payload agent) is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000;

vii) the fusosome comprises a lipid composition wherein one or more of CL, Cer, DAG, HexCer, LPA, LPC, LPE, LPG, LPI, LPS, PA, PC, PE, PG, PI, PS, CE, SM and TAG is within 75% of the corresponding lipid level in the source cell;

viii) the fusosome comprises a proteomic composition similar to that of the source cell, e.g., using an assay of Example 42;

ix) the fusosome comprises a ratio of lipids to proteins that is within 10%, 20%, 30%, 40%, or 50% of the corresponding ratio in the source cell, e.g., as measured using an assay of Example 49;

x) the fusosome comprises a ratio of proteins to nucleic acids (e.g., DNA) that is within 10%, 20%, 30%, 40%, or 50% of the corresponding ratio in the source cell, e.g., as measured using an assay of Example 50;

xi) the fusosome comprises a ratio of lipids to nucleic acids (e.g., DNA) that is within 10%, 20%, 30%, 40%, or 50% of the corresponding ratio in the source cell, e.g., as measured using an assay of Example 51;

xii) the fusosome has a half-life in a subject, e.g., in a mouse, that is within 90% of the half-life of a reference cell, e.g., the source cell, e.g., by an assay of Example 75;

xiii) the fusosome transports glucose (e.g., labeled glucose, e.g., 2-NBDG) across a membrane, e.g., by at least 10% more than a negative control, e.g., an otherwise similar fusosome in the absence of glucose, e.g., as measured using an assay of Example 64;

xiv) the fusosome comprises esterase activity in the lumen that is within 90% of that of the esterase activity in a reference cell, e.g., the source cell or a mouse embryonic fibroblast, e.g., using an assay of Example 66;

xv) the fusosome comprises a metabolic activity level that is within 90% of the metabolic activity (e.g., citrate synthase activity) in a reference cell, e.g., the source cell, e.g., as described in Example 68;

xvi) the fusosome comprises a respiration level (e.g., oxygen consumption rate) that is within 90% of the respiration level in a reference cell, e.g., the source cell, e.g., as described in Example 69;

xvii) the fusosome comprises an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, or 50% lower than the Annexin-V staining level of an otherwise similar fusosome treated with menadione in the assay of Example 70, or wherein the fusosome comprises an Annexin-V staining level at least 5%, 10%, 20%, 30%, 40%, or 50% lower than the Annexin-V staining level of a macrophage treated with menadione in the assay of Example 70;

xviii) the fusosome has a miRNA content level of at least 1% than that of the source cell, e.g., by an assay of Example 39;

xix) the fusosome has a soluble:non-soluble protein ratio is within 90% of that of the source cell, e.g., by an assay of Example 47;

xx) the fusosome has an LPS level less than 5% of the lipid content of fusosomes, e.g., as measured by an assay of Example 48;

xxi) the fusosome and/or compositions or preparations thereof, are capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 10% more than a negative control, e.g., an otherwise similar fusosome in the absence of insulin, e.g., using an assay of Example 63;

xxii) the fusosome has juxtacrine-signaling level of at least 5% greater than the level of juxtacrine signaling induced by a reference cell, e.g., the source cell or a bone marrow stromal cell (BMSC), e.g., by an assay of Example 71;

xxiii) the fusosome has paracrine-signaling level of at least 5% greater than the level of paracrine signaling induced by a reference cell, e.g., the source cell or a macrophage, e.g., by an assay of Example 72;

xxiv) the fusosome polymerizes actin at a level within 5% compared to the level of polymerized actin in a reference cell, e.g., the source cell or a C2C12 cell, e.g., by the assay of Example 73;
xxv) the fusosome has a membrane potential within about 5% of the membrane potential of a reference cell, e.g., the source cell or a C2C12 cell, e.g., by an assay of Example 74, or wherein the fusosome has a membrane potential of about −20 to ~150 mV, −20 to −50 mV, −50 to −100 mV, or −100 to −150 mV;
xxvi) the fusosome and/or compositions or preparations thereof, are capable of secreting a protein, e.g., at a rate at least 5% greater than a reference cell, e.g., a mouse embryonic fibroblast, e.g., using an assay of Example 62; or
xxvii) the fusosome has low immunogenicity, e.g., as described herein; and
c) (optionally) approving the plurality of fusosomes or fusosome composition for release if one or more of the standards is met;
thereby manufacturing a fusosome drug product composition.

349. A method of manufacturing a fusosome drug product composition, comprising:
a) providing, e.g., producing, providing a plurality of fusosomes according to any of embodiments 1-70, a fusosome composition of any of embodiments 71-97, or a pharmaceutical composition of embodiment 97; and
b) assaying one or more fusosomes from the plurality to determine the presence or level of one or more of the following factors:
i) an immunogenic molecule, e.g., an immunogenic protein, e.g., as described herein;
ii) a pathogen, e.g., a bacterium or virus; or
iii) a contaminant;
c) (optionally) approving the plurality of fusosomes or fusosome composition for release if one or more of the factors is below a reference value;
thereby manufacturing a fusosome drug product composition.

350. The method of embodiment 349, wherein if a detectable level, e.g., a value above a reference value, is determined, a sample containing the plurality of fusosomes or fusosome composition is discarded.

351. A method of manufacturing a fusosome composition, comprising:
a) providing a plurality of fusosomes described herein or a fusosome composition described herein; and
b) formulating the fusosomes, e.g., as a pharmaceutical composition suitable for administration to a subject.

352. A method of manufacturing a fusosome composition, comprising:
a) providing, e.g., producing, a plurality of fusosomes or a fusosome preparation described herein; and
b) assaying a sample of the plurality (e.g., of the preparation) to determine whether one or more (e.g., 2, 3, or more) standards are met.

353. A method of manufacturing a fusosome composition, comprising:
a) providing, e.g., producing, a plurality of fusosomes described herein or a fusosome composition or preparation described herein; and
b) assaying a sample of the plurality or preparation to determine the presence or level of one or more of the following factors:
i) an immunogenic molecule, e.g., an immunogenic protein, e.g., as described herein;
ii) a pathogen, e.g., a bacterium or virus; or
iii) a contaminant (e.g., a nuclear structure or component such as nuclear DNA); and
c) (optionally) approving the plurality of fusosomes or fusosome preparation for release if one or more of the factors is deviates significantly (e.g., by more than a specified amount) from a reference value or (optionally) formulating the plurality of fusosomes or the fusosome preparation as a drug product if the one or more factors does not significantly deviate (e.g., does not deviate by more than the specified about) from the reference value.

354. A method of manufacturing a fusosome composition, comprising:
i) providing a plurality of fusosomes, a fusosome composition, or a pharmaceutical composition as described herein; and
ii) formulating the plurality of fusosomes, fusosome composition, or pharmaceutical composition, e.g., as a fusosome drug product suitable for administration to a subject.

355. A method of manufacturing a fusosome composition, comprising:
a) providing a plurality of fusosomes, a fusosome composition, or a pharmaceutical composition as described herein; and
b) assaying one or more fusosomes from the plurality to determine the presence or level of one or more of the following factors:
i) an immunogenic molecule, e.g., an immunogenic protein, e.g., as described herein;
ii) a pathogen, e.g., a bacterium or virus; or
iii) a contaminant;
c) (optionally) approving the plurality of fusosomes or fusosome composition for release if one or more of the factors is below a reference value;
thereby manufacturing a fusosome drug product composition.

356. The method of any of embodiments 102-356, wherein one or more of the following is present:
i) the source cell is other than a 293 cell, HEK cell, human endothelial cell, or a human epithelial cell;
ii) the fusogen is other than a viral protein;
iii) a preparation comprising a plurality of the fusosomes has a density of other than between 1.08 g/mL and 1.12 g/mL;
iv) a preparation comprising a plurality of the fusosomes has a density of 1.25 g/mL+/−0.05, e.g., as measured by an assay of Example 33;
v) the fusosome is not substantially captured by the scavenger system in circulation or by Kupffer cells in the sinus of the liver;
vi) the fusosome is not substantially captured by the reticulo-endothelial system (RES) in a subject, e.g., by an assay of Example 76;
vii) when a plurality of fusosomes are administered to a subject, less than 1%, 2%, 3%, 4%, 5%, 10%, 20%, 30%, 40%, 50%, 60%, 70%, 80%, or 90% of the plurality are captured by the RES after 24, 48, or 72 hours, e.g., by an assay of Example 76;
viii) the fusosome has a diameter of greater than 5 μm, 6 μm, 7 μm, 8 μm, 10 μm, 20 μm, 50 μm, 100 μm, 150 μm, or 200 μm.
ix) the fusosome comprises a cytobiologic;
x) the fusosome comprises an enucleated cell; or
xi) the fusosome comprises an inactivated nucleus.

357. A method of administering a fusosome composition to a subject, e.g., a human subject, comprising administering to the subject a fusosome composition comprising a plurality of fusosomes according to any of embodiments 1-70, a fusosome composition of any of embodiments 71-97, or a pharmaceutical composition of embodiment 97, thereby administering the fusosome composition to the subject.

358. A method of delivering a payload (e.g., a membrane payload agent, nuclear payload agent, or organellar payload agent) to a subject, comprising administering to the subject a fusosome composition comprising a plurality of fusosomes according to any of embodiments 1-70, a fusosome composition of any of embodiments 71-97, or a pharmaceutical composition of embodiment 97, wherein the fusosome composition is administered in an amount and/or time such that the payload is delivered.

359. A method of modulating, e.g., enhancing, a biological function in a subject, comprising administering to the subject, or contacting the target tissue or the cell with, a plurality of fusosomes according to any of embodiments 1-70, a fusosome composition of any of embodiments 71-97, or a pharmaceutical composition of embodiment 97, thereby modulating the biological function in the subject.

360. The method of embodiment 359, wherein the biological function is selected from:
- a) modulating, e.g., increasing or decreasing, an interaction between two cells;
- b) modulating, e.g. increasing or decreasing, an immune response;
- c) modulating, e.g. increasing or decreasing, recruitment of cells to a target tissue;
- d) decreasing the growth rate of a cancer; or
- e) reducing the number of cancerous cells in the subject.

361. A method of delivering a function to a subject, comprising administering to the subject a plurality of fusosomes according to any of embodiments 1-70, a fusosome composition of any of embodiments 71-97, or a pharmaceutical composition of embodiment 97, wherein the fusosome composition is administered in an amount and/or time such that the function in the subject is delivered.

362. A method of targeting a function to a subject, comprising administering to the subject a plurality of fusosomes according to any of embodiments 1-70, a fusosome composition of any of embodiments 71-97, or a pharmaceutical composition of embodiment 97, wherein the fusosome composition is administered in an amount and/or time such that the function in the subject is targeted.

363. A method of delivering or targeting a function to a subject, comprising administering to the subject a fusosome composition comprising a plurality of fusosomes, a fusosome composition, or a pharmaceutical composition as described herein, wherein the fusosome composition is administered in an amount and/or time such that the function in the subject is delivered or targeted.

364. A method of treating a disease or disorder in a patient comprising administering to the subject a plurality of fusosomes according to any of embodiments 1-70, a fusosome composition of any of embodiments 71-97, or a pharmaceutical composition of embodiment 97, wherein the fusosome composition is administered in an amount and/or time such that the disease or disorder is treated.

365. The method of embodiment 364, wherein the disease or disorder is selected from cancer, autoimmune disorder, or infectious disease.

366. The method of any of embodiments 357-365, wherein the plurality of fusosomes has a local effect.

367. The method of any of embodiments 357-365, wherein the plurality of fusosomes has a distal effect.

368. The method of any of embodiments 357-365, wherein the plurality of fusosomes has a systemic effect.

369. The method of any of embodiments 357-368, wherein the subject has a cancer.

370. The method of embodiment 369, wherein the subject has a cancer and the fusosome comprises a neoantigen.

371. The method of any of embodiments 357-370, wherein the fusosome composition is administered to the subject at least 1, 2, 3, 4, or 5 times.

372. The method of any of embodiments 357-370, wherein the fusosome composition is administered to the subject systemically (e.g., orally, parenterally, subcutaneously, intravenously, intramuscularly, intraperitoneally) or locally.

373. The method of any of embodiments 357-372, wherein the fusosome composition is administered to the subject such that the fusosome composition reaches a target tissue selected from liver, lungs, heart, spleen, pancreas, gastrointestinal tract, kidney, testes, ovaries, brain, reproductive organs, central nervous system, peripheral nervous system, skeletal muscle, endothelium, inner ear, or eye.

374. The method of any of embodiments 357-373, wherein the fusosome composition is co-administered with an immunosuppressive agent, e.g., a glucocorticoid, cytostatic, antibody, or immunophilin modulator.

375. The method of any of embodiments 357-374, wherein the fusosome composition is co-administered with an immunostimulatory agent, e.g., an adjuvant, interleukin, cytokine, or chemokine.

376. The method of any of the preceding embodiments, wherein the method comprises delivering an agent to the cytosol of a target cell, optionally wherein the cytosol-delivered agent is a protein (or a nucleic acid encoding, or complementary to one encoding, the protein, e.g., an e.g., a DNA, a gDNA, a cDNA, an RNA, a pre-mRNA, an mRNA, etc. encoding the protein).

377. A method of administering a fusosome composition to a human subject, comprising:
- a) administering to the subject a first fusogen, under conditions that allow for disposition of the first fusogen in one or more target cells in the subject, wherein one or more of:
  - i) administering the first fusogen comprises administering a nucleic acid encoding the first fusogen, under conditions that allow for expression of the first fusogen in the one or more target cells, or
  - ii) the first fusogen does not comprise a coiled-coil motif, and
- b) administering to the human subject a fusosome composition comprising a plurality of fusosomes comprising a second fusogen, wherein the second fusogen is compatible with the first fusogen, wherein the plurality of fusosomes further comprise a payload (e.g., membrane payload agent, nuclear payload agent, or organellar payload agent);

thereby administering the fusosome composition to the subject.

378. A method of delivering a payload (e.g., membrane payload agent, nuclear payload agent, or organellar payload agent) to a subject, comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition comprising a plurality of fusosomes comprising a second fusogen and a therapeutic agent, wherein the second fusogen is compatible with the first fusogen, wherein the plurality of fusosomes further comprise a payload (e.g., membrane payload agent, nuclear payload agent, or organellar payload agent);

thereby delivering the payload (e.g., membrane payload agent, nuclear payload agent, or organellar payload agent) to the subject.

379. A method of modulating, e.g., enhancing, a biological function in a subject, comprising:

a) administering to the subject first fusogen, under conditions that allow for disposition of the first fusogen in one or more target cells in the subject, wherein one or more of:

i) administering the first fusogen comprises administering a nucleic acid encoding the first fusogen, under conditions that allow for expression of the first fusogen in the one or more target cells, or ii) the first fusogen does not comprise a coiled-coil motif, and b) administering to the human subject a fusosome composition comprising a plurality of fusosomes comprising a second fusogen, wherein the second fusogen is compatible with the first fusogen, wherein the plurality of fusosomes further comprise a payload (e.g., membrane payload agent, nuclear payload agent, or organellar payload agent);

thereby modulating the biological function in the subject.

380. The method of any of embodiments 377-379, wherein the payload (e.g., membrane payload agent, nuclear payload agent, or organellar payload agent) is exogenous or overexpressed relative to the source cell.

381. The method of any of embodiments 377-379, wherein the payload (e.g., membrane payload agent, nuclear payload agent, or organellar payload agent) comprises or encodes one or more of:

i) a transcriptional activator, e.g., a transcriptional activator of Table 17-1;

ii) a transcriptional repressor, e.g., a transcriptional repressor of Table 171;

iii) an epigenetic modifier, e.g., an epigenetic modifier of Table 17-1;

iv) a histone acetyltransferase, e.g., a histone acetyltransferase of Table 17-1;

v) a histone deacetylase, e.g., a histone deacetylase of Table 17-1;

vi) a histone methyltransferase, e.g., a histone methyltransferase of Table 17-1;

vii) a DNA methyltransferase, e.g., a DNA methyltransferase of Table 17-1;

viii) a DNA nickase, e.g., a DNA nickase as described herein;

ix) a site-specific DNA editing enzyme, e.g., a deaminase, e.g., of Table 17-1;

x) a DNA transposase, e.g., a DNA transposase as described herein;

xi) a DNA integrase, e.g., a DNA integrase as described herein;

xii) an RNA editor, e.g., an RNA editor of Table 17-1;

xiii) an RNA splicing factor, e.g., an RNA splicing factor of Table 17-1; or xiv) a PIWI protein, e.g., a PIWI protein as described herein.

382. The method of any of the preceding embodiments, wherein the plurality of fusosomes has a local effect or has a distal effect.

383. The method of any of the preceding embodiments, comprising providing a source cell expressing a fusogen comprises expressing an exogenous fusogen in the source cell or upregulating expression of an endogenous fusogen in the source cell.

384. The method of any of the preceding embodiments, comprising inactivating the nucleus of the source cell.

385. The method of any of the preceding embodiments, comprising enucleating a mammalian cell, e.g., by chemical enucleation, use of mechanical force e.g., use of a filter or centrifuge, at least partial disruption of the cytoskeleton, or a combination thereof.

386. The method of any of the preceding embodiments, comprising expressing a fusogen or other membrane protein in the source cell.

387. The method of any of the preceding embodiments, comprising one or more of: vesiculation, hypotonic treatment, extrusion, or centrifugation.

388. The method of any of the preceding embodiments, comprising genetically expressing an exogenous agent in the source cell or loading the exogenous agent into the source cell or fusosome.

389. The method of any of the preceding embodiments, comprising contacting the cell with DNA encoding a polypeptide agent, e.g., before inactivating the nucleus, e.g., enucleating the cell.

390. The method of any of the preceding embodiments, comprising contacting the cell with RNA encoding a polypeptide agent, e.g., before or after inactivating the nucleus, e.g., enucleating the cell.

391. The method of any of the preceding embodiments, comprising introducing a therapeutic agent (e.g., a nucleic acid or protein) into a fusosome, e.g., by electroporation.

392. The method of any of the preceding embodiments, wherein the fusosome is from a mammalian cell having a modified genome, e.g., to reduce immunogenicity (e.g., by genome editing, e.g., to remove an MHC protein); optionally wherein the method further comprises contacting the source cell of step a) with an immunosuppressive agent, e.g., before or after inactivating the nucleus, e.g., enucleating the cell.

393. The method of any of the preceding embodiments, wherein if a detectable level, e.g., a value above a reference value, is determined, a sample containing the plurality of fusosomes or fusosome composition or preparation is discarded.

394. The method of any of the preceding embodiments, further comprising a step of:

a) monitoring one or more of cancer progression, tumor recession, tumor volume, decrease in neoplastic cell number, quantity of fused cells, quantity of fused cells comprising a payload (e.g., a membrane payload agent, nuclear payload agent, or organellar payload agent), quantity of fused cells expressing a nucleic acid protein payload, and quantity of membrane protein disposed in membrane of a fused cell; and/or b) monitoring adverse events in the organism; optionally wherein the adverse event includes one or more of cytokine release syndrome, fever, tachycardia, chills, anorexia, nausea, vomiting, myalgia, headaches, capillary leak syndrome, hypotension, pulmonary edema, coagulopathy, renal dysfunction, kidney injury, macrophage-activation syndrome, hemophagocytic lymphohistiocytosis, organ failure, cerebral edema, bystander inflammation from T cell activation, neurologic symptoms, encephalopathy, confusion, hallucination, delirium, obtundation, aphasia, seizures, B-cell aplasia, tumor lysis syndrome, and graft versus host disease.

395. The method of any of embodiments 377-379, wherein the first fusogen is not a lipopeptide.

396. The method of any of embodiments 357-395, further comprising a step of:

monitoring one or more of quantity of fused cells, quantity of fused cells comprising a payload (e.g., membrane payload agent, nuclear payload agent, or organellar payload agent), quantity of fused cells expressing a payload (e.g., membrane payload agent, nuclear payload agent, or organellar payload agent), and quantity of membrane protein disposed in the nucleus of a fused cell.

397. The method of any of embodiments 357-396, further comprising a step of monitoring adverse events in the organism.

398. The method of embodiment 397, wherein the adverse event includes one or more of cytokine release syndrome, fever, tachycardia, chills, anorexia, nausea, vomiting, myalgia, headaches, capillary leak syndrome, hypotension, pulmonary edema, coagulopathy, renal dysfunction, kidney injury, macrophage-activation syndrome, hemophagocytic lymphohistiocytosis, organ failure, cerebral edema, bystander inflammation from T cell activation, neurologic symptoms, encephalopathy, confusion, hallucination, delirium, obtundation, aphasia, seizures, B-cell aplasia, tumor lysis syndrome, and graft versus host disease.

399. The method of any of embodiments 357-398, wherein the organism is a human.

400. The method of embodiment 399, wherein the human has a disease, disorder, or condition.

401. The method of embodiment 400, wherein presence of the payload (e.g., membrane payload agent, nuclear payload agent, or organellar payload agent, e.g., membrane protein payload agent, nuclear protein payload agent, or organellar protein payload agent) in the cell membrane lipid bilayer of the target cell improves one or more symptoms of the disease, disorder, or condition.

402. The fusosome, fusosome composition, fusosome preparation, or method any of the preceding embodiments, wherein the CAR is or comprises:

a) a first generation CAR comprising an antigen binding domain, a transmembrane domain, and signaling domain (e.g., one, two or three signaling domains);

b) a third generation CAR comprising an antigen binding domain, a transmembrane domain, and at least three signaling domains;

c) a fourth generation CAR comprising an antigen binding domain, a transmembrane domain, three or four signaling domains, and a domain which upon successful signaling of the CAR induces expression of a cytokine gene;

optionally wherein the antigen binding domain is or comprises an scFv or Fab.

403. The fusosome, fusosome composition, fusosome preparation, or method of embodiment 401 or 402, wherein a CAR antigen binding domain binds to a ligand expressed on B cells, plasma cells, plasmablasts, CD10, CD19, CD20, CD22, CD24, CD27, CD38, CD45R, CD138, CD319, BCMA, CD28, TNF, interferon receptors, GM-CSF, ZAP-70, LFA-1, CD3 gamma, CD5 or CD2.

404. The fusosome, fusosome composition, fusosome preparation, or method of any of embodiments 401-403, wherein the CAR transmembrane domain comprises at least a transmembrane region of the alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, or functional variant thereof.

405. The fusosome, fusosome composition, fusosome preparation, or method of any of embodiments 401-404, wherein the transmembrane domain comprises at least a transmembrane region(s) of CD8α, CD8β, 4-1BB/CD137, CD28, CD34, CD4, FcεRIγ, CD16, OX40/CD134, CD3ζ, CD3ε, CD3γ, CD3δ, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or functional variant thereof.

406. The fusosome, fusosome composition, fusosome preparation, or method of any of embodiments 401-405, wherein the CAR comprises at least one signaling domain selected from one or more of B7-1/CD80; B7-2/CD86; B7-H1/PD-L1; B7-H2; B7-H3; B7-H4; B7-H6; B7-H7; BTLA/CD272; CD28; CTLA-4; Gi24/VISTA/B7-H5; ICOS/CD278; PD-1; PD-L2/B7-DC; PDCD6); 4-1BB/TNFSF9/CD137; 4-1BB Ligand/TNFSF9; BAFF/BLyS/TNFSF13B; BAFF R/TNFRSF13C; CD27/TNFRSF7; CD27 Ligand/TNFSF7; CD30/TNFRSF8; CD30 Ligand/TNFSF8; CD40/TNFRSF5; CD40/TNFSF5; CD40 Ligand/TNFSF5; DR3/TNFRSF25; GITR/TNFRSF18; GITR Ligand/TNFSF18; HVEM/TNFRSF14; LIGHT/TNFSF14; Lymphotoxin-alpha/TNF-beta; OX40/TNFRSF4; OX40 Ligand/TNFSF4; RELT/TNFRSF19L; TACI/TNFRSF13B; TL1A/TNFSF15; TNF-alpha; TNF RII/TNFRSF1B); 2B4/CD244/SLAMF4; BLAME/SLAMF8; CD2; CD2F-10/SLAMF9; CD48/SLAMF2; CD58/LFA-3; CD84/SLAMF5; CD229/SLAMF3; CRACC/SLAMF7; NTB-A/SLAMF6; SLAM/CD150); CD2; CD7; CD53; CD82/Kai-1; CD90/Thy1; CD96; CD160; CD200; CD300a/LMIR1; HLA Class I; HLA-DR; Ikaros; Integrin alpha 4/CD49d; Integrin alpha 4 beta 1; Integrin alpha 4 beta 7/LPAM-1; LAG-3; TCL1A; TCL1B; CRTAM; DAP12; Dectin-1/CLEC7A; DPPIV/CD26; EphB6; TIM-1/KIM-1/HAVCR; TIM-4; TSLP; TSLP R; lymphocyte function associated antigen-1 (LFA-1); NKG2C, a CD3 zeta domain, an immunoreceptor tyrosine-based activation motif (ITAM), CD27, CD28, 4-1BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83, or functional fragment thereof.

407. The fusosome, fusosome composition, fusosome preparation, or method of any of embodiments 401-406, wherein the CAR comprises a CD3 zeta domain or an immunoreceptor tyrosine-based activation motif (ITAM), or functional variant thereof. In some embodiments, the CAR comprises (i) a CD3 zeta domain, or an immunoreceptor tyrosine-based activation motif (ITAM), or functional variant thereof; (ii) a CD28 domain, or a 4-1BB domain, or functional variant thereof, and/or (iii) a 4-1BB domain, or a CD134 domain, or functional variant thereof.

408. The fusosome, fusosome composition, fusosome preparation, or method of any of embodiments 401-407, wherein the CAR further comprises one or more spacers, e.g., wherein the spacer is a first spacer between the antigen binding domain and the transmembrane domain, optionally wherein the first spacer includes at least a portion of an immunoglobulin constant region or variant or modified version thereof, optionally wherein the spacer is a second spacer between the transmembrane domain and a signaling domain, optionally wherein the second spacer is an oligopeptide, e.g., wherein the oligopeptide comprises glycine-serine doublets.

409. The fusosome, fusosome composition, fusosome preparation, or method of any of the preceding embodiments, wherein the antigen binding domain targets an antigen characteristic of a neoplastic cell.

410. The fusosome, fusosome composition, fusosome preparation, or method of embodiment 409, wherein the antigen characteristic of a neoplastic cell is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB 1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multispan transmembrane protein, T-cell receptor motifs; T-cell alpha chains; T-cell β chains; T-cell γ chains; T-cell δ chains; CCR7; CD3; CD4; CD5; CD7; CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; TREG; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-γ2, VEGF, VEGFR 1/2/3, αVβ3, α5β1, ErbB1/EGFR, ErbB 1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-1β, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13R□1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A,B,C) CD49f, CD151 CD340, CD200, tkrA, trkB, or trkC, or an antigenic fragment or antigenic portion thereof.

411. The fusosome, fusosome composition, fusosome preparation, or method of any of the preceding embodiments, wherein the antigen binding domain targets an antigen characteristic of a T-cell.

412. The fusosome, fusosome composition, fusosome preparation, or method of embodiment 411, wherein the antigen characteristic of a T-cell is selected from a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T-cell.

413. The fusosome, fusosome composition, fusosome preparation, or method of embodiment 411 or 412, wherein the antigen characteristic of a T-cell may be a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, AKT1; AKT2; AKT3; ATF2; BCL10; CALM1; CD3D (CD3δ); CD3E (CD3ε); CD3G (CD3γ); CD4; CD8; CD28; CD45; CD80 (B7-1); CD86 (B7-2); CD247 (CD3ζ); CTLA4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38β); MAPK12 (p38γ); MAPK13 (p38δ); MAPK14 (p38α); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

414. The fusosome, fusosome composition, fusosome preparation, or method of any of the preceding embodiments, wherein the antigen binding domain targets an antigen characteristic of an autoimmune or inflammatory disorder.

415. The fusosome, fusosome composition, fusosome preparation, or method of embodiment 414, wherein the autoimmune or inflammatory disorder is selected from chronic graft-vs-host disease (GVHD), lupus, arthritis, immune complex glomerulonephritis, goodpasture, uveitis, hepatitis, systemic sclerosis or scleroderma, type I diabetes, multiple sclerosis, cold agglutinin disease, Pemphigus vulgaris, Grave's disease, autoimmune hemolytic anemia, Hemophilia A, Primary Sjogren's Syndrome, thrombotic thrombocytopenia purrpura, neuromyelits optica, Evan's syndrome, IgM mediated neuropathy, cyroglobulinemia, dermatomyositis, idiopathic thrombocytopenia, ankylosing spondylitis, bullous pemphigoid, acquired angioedema, chronic urticarial, antiphospholipid demyelinating polyneuropathy, and autoimmune thrombocytopenia or neutropenia or pure red cell aplasias, while exemplary non-limiting examples of alloimmune diseases include allosensitization (see, for example, Blazar et al., 2015, Am. J. Transplant, 15(4):931-41) or xenosensitization from hematopoietic or solid organ transplantation, blood transfusions, pregnancy with fetal allosensitization, neonatal alloimmune thrombocytopenia, hemolytic disease of the newborn, sensitization to foreign antigens such as can occur with replacement of inherited or acquired deficiency disorders treated with enzyme or protein replacement therapy, blood products, and gene therapy, optionally wherein the antigen characteristic of an autoimmune or inflammatory disorder is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor.

416. The fusosome, fusosome composition, fusosome preparation, or method of any of the preceding embodiments, wherein the antigen binding domain targets an antigen characteristic of an infectious disease.

417. The fusosome, fusosome composition, fusosome preparation, or method of embodiment 416, wherein the infectious disease is selected from HIV, hepatitis B virus, hepatitis C virus, Human herpes virus, Human herpes virus 8 (HHV-8, Kaposi sarcoma-associated herpes virus (KSHV)), Human T-lymphotrophic virus-1 (HTLV-1), Merkel cell polyomavirus (MCV), Simian virus 40 (SV40), Eptstein-Barr virus, CMV, human papillomavirus, optionally wherein the antigen characteristic of an infectious disease is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, HIV Env, gp120, or CD4-induced epitope on HIV-1 Env.

418. The fusosome, fusosome composition, fusosome preparation, or method of any of the preceding embodiments, wherein the target cell comprises an aggregated or misfolded membrane protein.

419. The fusosome, fusosome composition, fusosome preparation, or method of any of the preceding embodiments, wherein the fusosome and/or compositions or preparations thereof, are capable of reducing levels (e.g., reduces levels) of the aggregated or misfolded protein in the target cell, or a method herein comprises reducing levels of the aggregated or misfolded protein in the target cell.

420. The fusosome, fusosome composition, fusosome preparation, or method of any of the preceding embodiments, wherein the fusosome and/or compositions or preparations thereof, are capable of delivering (e.g., deliver) a membrane protein to the cell membrane of a target cell.

421. The fusosome, fusosome composition, fusosome preparation, or method of embodiment 420, wherein delivering the protein comprises delivering a nucleic acid (e.g., a DNA, a gDNA, a cDNA, an RNA, a pre-mRNA, an mRNA, etc.) encoding the protein to the target cell such that the target cell produces the protein and localizes it to the membrane.

422. The fusosome, fusosome composition, fusosome preparation, or method of embodiment 420 or 421, wherein the fusosome comprises, or the method further comprises delivering, the protein, and fusion of the fusosome with the target cell transfers the protein to the cell membrane of the target cell.

423. The fusosome, fusosome composition, fusosome preparation, or method of any of embodiments 420-422, wherein the protein comprises a cell surface ligand or an antibody that binds a cell surface receptor.

424. The fusosome, fusosome composition, fusosome preparation, or method of any of the preceding embodiments, wherein the fusosome further comprises, or the method further comprises delivering, a second agent that comprises or encodes a second cell surface ligand or antibody that binds a cell surface receptor, and optionally further comprising or encoding one or more additional cell surface ligands or antibodies that bind a cell surface receptor (e.g., 1, 2, 3, 4, 5, 10, 20, 50, or more).

425. The fusosome, fusosome composition, fusosome preparation, or method of embodiment 424, wherein the first agent and the second agent form a complex, wherein optionally the complex further comprises one or more additional cell surface ligands.

426. The fusosome, fusosome composition, fusosome preparation, or method of any of the preceding embodiments, wherein the agent comprises or encodes a cell surface receptor, e.g., a cell surface that is exogenous or overexpressed relative to the source cell.

427. The fusosome, fusosome composition, fusosome preparation, or method of any of the preceding embodiments, wherein the fusosomes further comprise, or the method further comprises delivering, a second agent that comprises or encodes a second cell surface receptor, and optionally further comprises or encodes one or more additional cell surface receptors (e.g., 1, 2, 3, 4, 5, 10, 20, 50, or more cell surface receptors).

428. The fusosome, fusosome composition, fusosome preparation, or method of embodiment 427, wherein the second agent, e.g., therapeutic agent, is selected from a protein, protein complex (e.g., comprising at least 2, 3, 4, 5, 10, 20, or 50 proteins, e.g., at least at least 2, 3, 4, 5, 10, 20, or 50 different proteins) polypeptide, nucleic acid (e.g., DNA, chromosome, or RNA, e.g., mRNA, siRNA, or miRNA) or small molecule.

429. The fusosome, fusosome composition, fusosome preparation, or method of embodiment 427 or 428, wherein the first agent and the second agent form a complex, wherein optionally the complex further comprises one or more additional cell surface receptors, optionally wherein the the agent comprises or encodes an antigen or an antigen presenting protein.

430. The fusosome, fusosome composition, fusosome preparation, or method of any of the preceding embodiments, wherein the fusosome, and/or composition or preparation thereof, delivers or is capable of delivering (e.g., deliver) a secreted agent, e.g., a secreted protein to a target site (e.g., an extracellular region), e.g., by delivering a nucleic acid (e.g., a DNA, a gDNA, a cDNA, an RNA, a pre-mRNA, an mRNA, etc.) encoding the protein to the target cell under conditions that allow the target cell to produce and secrete the protein.

431. The fusosome, fusosome composition, fusosome preparation, or method of embodiment 430, wherein the secreted protein is endogenous or exogenous relative to the source cell or relative to the target cell. 432. The fusosome, fusosome composition, fusosome preparation, or method of embodiment 430 or 431, wherein the secreted protein comprises a protein therapeutic, e.g., an antibody molecule, a cytokine, an enzyme, an autocrine signalling molecule, a paracrine signalling molecule, or a secretory granule.

433. The fusosome, fusosome composition, fusosome preparation, or method of any of the preceding embodiments, wherein the fusosome, and/or composition or preparation thereof, delivers or is capable of delivering (e.g., deliver) a membrane protein or a secreted protein that is or comprises an antigen.

434. The fusosome, fusosome composition, fusosome preparation, or method of embodiment 433, wherein the fusosome, and/or composition or preparation thereof, delivers or is capable of delivering (e.g., deliver) a membrane protein or a secreted protein that is or comprises an antigen antigen presenting protein, optionally together (e.g., as a complex) with an antigen.

435. The fusosome, fusosome composition, fusosome preparation, or method of any of the preceding embodiments, wherein the fusosome, and/or composition or preparation thereof, donates or is capable of donating (e.g., donate) one or more cell surface receptors to a target cell (e.g., an immune cell).

436. The fusosome, fusosome composition, fusosome preparation, or method of any of the preceding embodiments, wherein the target cell is or comprises a tumor cell.

437. The fusosome, fusosome composition, fusosome preparation, or method of any of the preceding embodiments, wherein the fusosome, and/or composition or preparation thereof, delivers or is capable of delivering (e.g., deliver) a membrane or secreted protein that is or comprises an immunostimulatory ligand, an antigen presenting protein, a tumor suppressor protein, a pro-apoptotic protein, or a receptor or binding partner for any of the foregoing.

438. The fusosome, fusosome composition, fusosome preparation, or method of any of the preceding embodiments, wherein the fusosome comprises an agent (e.g., a membrane payload agent, nuclear payload agent, or organellar payload agent, and optionally at least one second agent) that is immunomodulatory, e.g., immunostimulatory.

439. The fusosome, fusosome composition, fusosome preparation, or method of any of the preceding embodiments, wherein the fusosome, and/or composition or preparation thereof, causes or is capable of causing (e.g., cause) the target cell to present an antigen.

440. The fusosome, fusosome composition, fusosome preparation, or method of any of the preceding embodiments, wherein the fusosome, and/or composition or preparation thereof, delivers or is capable of delivering (e.g., deliver) a nucleic acid to a target cell, e.g., to transiently modify gene expression in the target cell or to modify, for example by integration into, the genome of the target cell, for example to cause expression of a membrane protein (or secreted protein) as described herein.

441. The fusosome, fusosome composition, fusosome preparation, or method of any of the preceding embodiments, wherein the fusosome, and/or composition or preparation thereof, delivers or is capable of delivering (e.g., deliver) a protein (e.g., a membrane protein such as a transporter protein or a secreted protein such as an immunosuppressive protein) to a target cell so that a protein deficiency of the target cell is rescued, at least transiently.

442. The fusosome, fusosome composition, fusosome preparation, or method of embodiment 441, the membrane protein may include one or more covalently-associated non-peptide moieties such as, for example, one or more carbohydrate moieties, lipid moieties, polyethylene glycol moieties, small molecules, etc, and combinations thereof.

443. The fusosome, fusosome composition, fusosome preparation, or method of any of the preceding embodiments, wherein the fusosome, and/or composition or preparation thereof, causes or is capable of causing (e.g., cause) a target cell to secrete a protein, e.g., a therapeutic protein.

444. The fusosome, fusosome composition, fusosome preparation, or method of any of the preceding embodiments, wherein the fusosome having a cell surface ligand is from a source cell chosen from a neutrophil (e.g., and the target cell is a tumor-infiltrating lymphocyte), dendritic cell (e.g., and the target cell is a naïve T cell), or neutrophil (e.g., and the target is a tumor cell or virus-infected cell).

445. The fusosome, fusosome composition, fusosome preparation, or method of embodiment 444, wherein the fusosome comprises a membrane complex, e.g., a complex comprising at least 2, 3, 4, or 5 proteins, e.g., a homodimer, heterodimer, homotrimer, heterotrimer, homotetramer, or heterotetramer.

446. The fusosome, fusosome composition, fusosome preparation, or method of embodiment 444 or 445, wherein the fusosome comprises an antibody, e.g., a toxic antibody, e.g., the fusosome and/or compositions or preparations thereof, are capable of delivering (e.g., deliver) the antibody to the target site, e.g., by homing to a target site.

447. The fusosome, fusosome composition, fusosome preparation, or method of any of the preceding embodiments, wherein the source cell is an NK cell or a neutrophil.

448. The fusosome, fusosome composition, fusosome preparation, or method of any of the preceding embodiments, wherein the membrane protein is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB 1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GABA receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multispan transmembrane protein, T-cell receptor motifs; T-cell alpha chains; T-cell β chains; T-cell γ chains; T-cell δ chains; CCR7; CD3; CD4; CD5; CD7; CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; TREG; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-γ2, VEGF, VEGFR 1/2/3, αVβ3, α5β1, ErbB1/EGFR, ErbB 1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-1β, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13R□1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A,B,C) CD49f, CD151 CD340, CD200, tkrA, trkB, or trkC.

449. The fusosome, fusosome composition, fusosome preparation, or method of any of the preceding embodiments, wherein the fusosome associates with and/or binds a target cell or a surface feature of a target cell.

450. The fusosome, fusosome composition, fusosome preparation, or method of any of the preceding embodiments, wherein the fusosome, and/or composition or preparation thereof, causes or is capable of causing secretion of a protein from a target cell or ligand presentation on the surface of a target cell.

451. The fusosome, fusosome composition, fusosome preparation, or method of embodiment 450, wherein the fusosome and/or compositions or preparations thereof, causes or is capable of causing cell death of the target cell.

452. The fusosome, fusosome composition, fusosome preparation, or method of embodiment 450 or 451, wherein the fusosome is from a NK source cell.

453. The fusosome, fusosome composition, fusosome preparation, or method of any of the preceding embodiments, wherein the fusosome, and/or composition or preparation thereof, senses and/or responses, or is capable of sending and/or responding to one or more local environment features, e.g., metabolite, interleukin, antigen, etc or combinations thereof.

454. The fusosome, fusosome composition, fusosome preparation, or method of any of the preceding embodiments, wherein the fusosome, and/or composition or preparation thereof, is capable of chemotaxis, extravasation, and/or one or more metabolic activities (e.g., kyneurinine, gluconeogenesis, prostaglandin fatty acid oxidation, adenosine metabolism, urea cycle, and thermogenic respiration).

455. The fusosome, fusosome composition, fusosome preparation, or method of embodiment 454, wherein the source cell is:
a) a neutrophil and the fusosome and/or compositions or preparations thereof, are capable of homing to a site of injury;
b) a macrophage and the fusosome and/or compositions or preparations thereof, are capable of phagocytosis or
c) a brown adipose tissue cell and the fusosome and/or compositions or preparations thereof, are capable of lipolysis.

456. The fusosome, fusosome composition, fusosome preparation, or method of any of the preceding embodiments, wherein the fusosome:
a) the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, e.g., in an assay of Example 54;
b) the fusosome fuses at a higher rate with a target cell than other fusosomes, e.g., by at least 10%, 20%, 30%, 40%, 50%, 60%, 70%, 80%, or 90%, e.g., in an assay of Example 54; and/or
c) the fusosome fuses with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 54.

457. The fusosome, fusosome composition, fusosome preparation, or method of any of the preceding embodiments, wherein the fusosome:
a) is present, per fusosome, at a copy number of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 29; or
b) is present at a copy number of at least 1,000 copies, e.g., as measured by an assay of Example 29.

458. The fusosome, fusosome composition, fusosome preparation, or method of any of the preceding embodiments, wherein at least 10%, 20%, 30%, 40%, 50%, 60%, 70%, 80%, 90%, 95%, 96%, 97%, 98%, or 99% of the fusogen comprised by the fusosome is disposed in the cell membrane.

459. The fusosome, fusosome composition, fusosome preparation, or method of any of the preceding embodiments, wherein the fusosome also comprises fusogen internally, e.g., in the cytoplasm or an organelle.

460. The fusosome, fusosome composition, fusosome preparation, or method of any of the preceding embodiments, wherein the fusosome comprises:
a) a therapeutic agent (e.g., a therapeutic membrane payload agent, nuclear payload agent, or organellar payload agent) at a copy number per fusosome of at least, or no more than, 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 43;
b) a protein therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies, e.g., as measured by an assay of Example 43;
c) a nucleic acid therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies;
d) a DNA therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies;
e) an RNA therapeutic agent at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies;
f) a therapeutic agent that is exogenous relative to the source cell at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies;
g) a protein therapeutic agent that is exogenous relative to the source cell at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies; and/or
h) a nucleic acid (e.g., DNA or RNA) therapeutic agent that is exogenous relative to the source cell at a copy number of at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies.

461. The fusosome, fusosome composition, fusosome preparation, or method of any of the preceding embodiments, wherein the ratio of the copy number of the fusogen to the copy number of the therapeutic agent is between 1,000,000:1 and 100,000:1, 100,000:1 and 10,000:1, 10,000:1 and 1,000:1, 1,000:1 and 100:1, 100:1 and 50:1, 50:1 and 20:1, 20:1 and 10:1, 10:1 and 5:1, 5:1 and 2:1, 2:1 and 1:1, 1:1 and 1:2, 1:2 and 1:5, 1:5 and 1:10, 1:10 and 1:20, 1:20 and 1:50, 1:50 and 1:100, 1:100 and 1:1,000, 1:1,000 and 1:10,000, 1:10,000 and 1:100,000, or 1:100,000 and 1:1,000,000.

462. The fusosome, fusosome composition, fusosome preparation, or method of any of the preceding embodiments, wherein the fusosome delivers to a target cell:
a) at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a therapeutic agent (e.g., a therapeutic membrane payload agent, nuclear payload agent, or organellar payload agent);
b) at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies of a protein therapeutic agent;
c) at least 10, 50, 100, 500, 1,000, 2,000, 5,000, 10,000, 20,000, 50,000, 100,000, 200,000, 500,000, 1,000,000, 5,000,000, 10,000,000, 50,000,000, 100,000, 000, 500,000,000, or 1,000,000,000 copies of a nucleic acid therapeutic agent;

d) at least 10, 50, 100, 500, 1,000, 2,000, 5,000, 10,000, 20,000, 50,000, 100,000, 200,000, 500,000, 1,000, 000, 5,000,000, 10,000,000, 50,000,000, 100,000, 000, 500,000,000, or 1,000,000,000 copies of an RNA therapeutic agent; and/or e) at least 10, 50, 100, 500, 1,000, 2,000, 5,000, 10,000, 20,000, 50,000, 100,000, 200,000, 500,000, 1,000, 000, 5,000,000, 10,000,000, 50,000,000, 100,000, 000, 500,000,000, or 1,000,000,000 copies of a DNA therapeutic agent.

463. The fusosome, fusosome composition, fusosome preparation, or method of any of the preceding embodiments, wherein the fusosome, and/or composition or preparation thereof, comprises:

a) 0.00000001 mg fusogen to 1 mg fusogen per mg of total protein in fusosome, e.g., 0.00000001-0.0000001, 0.0000001-0.000001, 0.000001-0.00001, 0.00001-0.0001, 0.0001-0.001, 0.001-0.01, 0.01-0.1, or 0.1-1 mg fusogen per mg of total protein in fusosome; or b) 0.00000001 mg fusogen to 5 mg fusogen per mg of lipid in fusosome, e.g., 0.00000001-0.0000001, 0.0000001-0.000001, 0.000001-0.00001, 0.00001-0.0001, 0.0001-0.001, 0.001-0.01, 0.01-0.1, 0.1-1, or 1-5 mg fusogen per mg of lipid in fusosome.

464. The fusosome, fusosome composition, fusosome preparation, or method of any of the preceding embodiments, wherein the fusosome, and/or composition or preparation thereof, is characterized by a lipid composition substantially similar to that of the source cell or wherein one or more of CL, Cer, DAG, HexCer, LPA, LPC, LPE, LPG, LPI, LPS, PA, PC, PE, PG, PI, PS, CE, SM and TAG is within 10%, 15%, 20%, 25%, 30%, 35%, 40%, 45%, or 50%, e.g., within 75%, of the corresponding lipid level in the source cell.

465. The fusosome, fusosome composition, fusosome preparation, or method of any of the preceding embodiments, wherein the fusosome, and/or composition or preparation thereof, is characterized by a ratio of cardiolipin:ceramide that is within 10%, 20%, 30%, 40%, or 50% of the ratio of cardiolipin:ceramide in the source cell; or by a ratio of cardiolipin:diacylglycerol that is within 10%, 20%, 30%, 40%, or 50% of the ratio of cardiolipin:diacylglycerol in the source cell; or by a ratio of cardiolipin:hexosylceramide that is within 10%, 20%, 30%, 40%, or 50% of the ratio of cardiolipin:hexosylceramide in the source cell; or by a ratio of cardiolipin:lysophosphatidate that is within 10%, 20%, 30%, 40%, or 50% of the ratio of cardiolipin:lysophosphatidate in the source cell; or by a ratio of cardiolipin:lyso-phosphatidylcholine that is within 10%, 20%, 30%, 40%, or 50% of the ratio of cardiolipin:lyso-phosphatidylcholine in the source cell; or by a ratio of cardiolipin:lyso-phosphatidylethanolamine that is within 10%, 20%, 30%, 40%, or 50% of the ratio of cardiolipin:lyso-phosphatidylethanolamine in the source cell; or by a ratio of cardiolipin:lyso-phosphatidylglycerol that is within 10%, 20%, 30%, 40%, or 50% of the ratio of cardiolipin:lyso-phosphatidylglycerol in the source cell; or by a ratio of cardiolipin:lyso-phosphatidylinositol that is within 10%, 20%, 30%, 40%, or 50% of the ratio of cardiolipin:lyso-phosphatidylinositol in the source cell; or by a ratio of cardiolipin:lyso-phosphatidylserine that is within 10%, 20%, 30%, 40%, or 50% of the ratio of cardiolipin:lyso-phosphatidylserine in the source cell; or by a ratio of cardiolipin:phosphatidate that is within 10%, 20%, 30%, 40%, or 50% of the ratio of cardiolipin:phosphatidate in the source cell; or by a ratio of cardiolipin:phosphatidylcholine that is within 10%, 20%, 30%, 40%, or 50% of the ratio of cardiolipin:phosphatidylcholine in the source cell; or by a ratio of cardiolipin:phosphatidylethanolamine that is within 10%, 20%, 30%, 40%, or 50% of the ratio of cardiolipin:phosphatidylethanolamine in the source cell; or by a ratio of cardiolipin:phosphatidylglycerol that is within 10%, 20%, 30%, 40%, or 50% of the ratio of cardiolipin:phosphatidylglycerol in the source cell; or by a ratio of cardiolipin:phosphatidylinositol that is within 10%, 20%, 30%, 40%, or 50% of the ratio of cardiolipin:phosphatidylinositol in the source cell; or by a ratio of cardiolipin:phosphatidylserine that is within 10%, 20%, 30%, 40%, or 50% of the ratio of cardiolipin:phosphatidylserine in the source cell; or by a ratio of cardiolipin:cholesterol ester that is within 10%, 20%, 30%, 40%, or 50% of the ratio of cardiolipin:cholesterol ester in the source cell; or by a ratio of cardiolipin:sphingomyelin that is within 10%, 20%, 30%, 40%, or 50% of the ratio of cardiolipin:sphingomyelin in the source cell; or by a ratio of cardiolipin:triacylglycerol that is within 10%, 20%, 30%, 40%, or 50% of the ratio of cardiolipin:triacylglycerol in the source cell; or by a ratio of phosphatidylcholine:ceramide that is within 10%, 20%, 30%, 40%, or 50% of the ratio of phosphatidylcholine:ceramide in the source cell; or by a ratio of phosphatidylcholine:diacylglycerol that is within 10%, 20%, 30%, 40%, or 50% of the ratio of phosphatidylcholine:diacylglycerol in the source cell; or by a ratio of phosphatidylcholine:hexosylceramide that is within 10%, 20%, 30%, 40%, or 50% of the ratio of phosphatidylcholine:hexosylceramide in the source cell; or by a ratio of phosphatidylcholine:lysophosphatidate that is within 10%, 20%, 30%, 40%, or 50% of the ratio of phosphatidylcholine:lysophosphatidate in the source cell; or by a ratio of phosphatidylcholine:lyso-phosphatidylcholine that is within 10%, 20%, 30%, 40%, or 50% of the ratio of phosphatidylcholine:lyso-phosphatidylcholine in the source cell; or by a ratio of phosphatidylcholine:lyso-phosphatidylethanolamine that is within 10%, 20%, 30%, 40%, or 50% of the ratio of phosphatidylcholine:lyso-phosphatidylethanolamine in the source cell; or by a ratio of phosphatidylcholine:lyso-phosphatidylglycerol that is within 10%, 20%, 30%, 40%, or 50% of the ratio of phosphatidylcholine:lyso-phosphatidylglycerol in the source cell; or by a ratio of phosphatidylcholine:lyso-phosphatidylinositol that is within 10%, 20%, 30%, 40%, or 50% of the ratio of phosphatidylcholine:lyso-phosphatidylinositol in the source cell; or by a ratio of phosphatidylcholine:lyso-phosphatidylserine that is within 10%, 20%, 30%, 40%, or 50% of the ratio of phosphatidylcholine:lyso-phosphatidylserine in the source cell; or by a ratio of phosphatidylcholine:phosphatidate that is within 10%, 20%, 30%, 40%, or 50% of the ratio of cardiolipin:phosphatidate in the source cell; or by a ratio of phosphatidylcholine:phosphatidylethanolamine that is within 10%, 20%, 30%, 40%, or 50% of the ratio of phosphatidylcholine:phosphatidylethanolamine in the source cell; or by a ratio of cardiolipin:phosphatidylglycerol that is within 10%, 20%, 30%, 40%, or 50% of the ratio of phosphatidylcholine:phosphatidylglycerol in the source cell; or by a ratio of phosphatidylcholine:phosphatidylinositol that is within 10%, 20%, 30%, 40%, or 50% of the ratio of phosphatidylcholine:phosphatidylinositol in the source cell; or by a ratio of phosphatidylcholine:phosphatidylserine that is within 10%, 20%, 30%, 40%, or 50% of the ratio of phosphatidylcholine:phosphatidylserine in the source cell; or by a ratio of phosphatidylcholine:cholesterol ester that is within 10%, 20%, 30%, 40%, or 50% of the ratio of phosphatidylcholine:cholesterol ester in the source cell; or by a ratio of phosphatidylcholine:sphingomyelin that is within 10%, 20%, 30%, 40%, or 50% of the ratio of phosphatidylcholine: sphingomyelin in the source cell; or by a ratio of phosphatidylcholine:triacylglycerol that is within 10%, 20%, 30%, 40%, or 50% of the ratio of phosphatidylcholine:triacylglycerol in the source cell; or by a ratio of phosphatidylethanolamine:ceramide that is within 10%, 20%, 30%, 40%, or 50% of the ratio of phosphatidylethanolamine:ceramide in the source cell; or by a ratio of phosphatidylethanolamine:diacylglycerol that is within 10%, 20%, 30%, 40%, or 50% of the ratio of phosphatidylethanolamine:diacylglycerol in the source cell; or by a ratio of phosphatidylethanolamine:hexosylceramide that is within 10%, 20%, 30%, 40%, or 50% of the ratio of phosphatidylethanolamine:hexosylceramide in the source cell; or by a ratio of phosphatidylethanolamine:lysophosphatidate that is within 10%, 20%, 30%, 40%, or 50% of the ratio of phosphatidylethanolamine:lysophosphatidate in the source cell; or by a ratio of phosphatidylethanolamine:lyso-phosphatidylcholine that is within 10%, 20%, 30%, 40%, or 50% of the ratio of phosphatidylethanolamine:lyso-phosphatidylcholine in the source cell; or by a ratio of phosphatidylethanolamine:lyso-phosphatidylethanolamine that is within 10%, 20%, 30%, 40%, or 50% of the ratio of phosphatidylethanolamine:lyso-phosphatidylethanolamine in the source cell; or by a ratio of phosphatidylethanolamine:lyso-phosphatidylglycerol that is within 10%, 20%, 30%, 40%, or 50% of the ratio of phosphatidylethanolamine:lyso-phosphatidylglycerol in the source cell; or by a ratio of phosphatidylethanolamine:lyso-phosphatidylinositol that is within 10%, 20%, 30%, 40%, or 50% of the ratio of phosphatidylethanolamine:lyso-phosphatidylinositol in the source cell; or by a ratio of phosphatidylethanolamine: lyso-phosphatidylserine that is within 10%, 20%, 30%, 40%, or 50% of the ratio of phosphatidylethanolamine: lyso-phosphatidylserine in the source cell; or by a ratio of phosphatidylethanolamine:phosphatidate that is within 10%, 20%, 30%, 40%, or 50% of the ratio of phosphatidylethanolamine:phosphatidate in the source cell; or by a ratio of phosphatidylethanolamine:phosphatidylglycerol that is within 10%, 20%, 30%, 40%, or 50% of the ratio of phosphatidylethanolamine:phosphatidylglycerol in the source cell; or by a ratio of phosphatidylethanolamine:phosphatidylinositol that is within 10%, 20%, 30%, 40%, or 50% of the ratio of phosphatidylethanolamine:phosphatidylinositol in the source cell; or by a ratio of phosphatidylethanolamine: phosphatidylserine that is within 10%, 20%, 30%, 40%, or 50% of the ratio of phosphatidylethanolamine: phosphatidylserine in the source cell; or by a ratio of phosphatidylethanolamine:cholesterol ester that is within 10%, 20%, 30%, 40%, or 50% of the ratio of phosphatidylethanolamine:cholesterol ester in the source cell; or by a ratio of phosphatidylethanolamine: sphingomyelin that is within 10%, 20%, 30%, 40%, or 50% of the ratio of phosphatidylethanolamine:sphingomyelin in the source cell; or by a ratio of phosphatidylethanolamine:triacylglycerol that is within 10%, 20%, 30%, 40%, or 50% of the ratio of phosphatidylethanolamine:triacylglycerol in the source cell; or by a ratio of phosphatidylserine:ceramide that is within 10%, 20%, 30%, 40%, or 50% of the ratio of phosphatidylserine:ceramide in the source cell; or by a ratio of phosphatidylserine:diacylglycerol that is within 10%, 20%, 30%, 40%, or 50% of the ratio of phosphatidylserine:diacylglycerol in the source cell; or by a ratio of phosphatidylserine:hexosylceramide that is within 10%, 20%, 30%, 40%, or 50% of the ratio of phosphatidylserine:hexosylceramide in the source cell; or by a ratio of phosphatidylserine:lysophosphatidate that is within 10%, 20%, 30%, 40%, or 50% of the ratio of phosphatidylserine:lysophosphatidate in the source cell; or by a ratio of phosphatidylserine:lyso-phosphatidylcholine that is within 10%, 20%, 30%, 40%, or 50% of the ratio of phosphatidylserine:lyso-phosphatidylcholine in the source cell; or by a ratio of phosphatidylserine:lyso-phosphatidylethanolamine that is within 10%, 20%, 30%, 40%, or 50% of the ratio of phosphatidylserine:lyso-phosphatidylethanolamine in the source cell; or by a ratio of phosphatidylserine:lyso-phosphatidylglycerol that is within 10%, 20%, 30%, 40%, or 50% of the ratio of phosphatidylserine:lyso-phosphatidylglycerol in the source cell; or by a ratio of phosphatidylserine:lyso-phosphatidylinositol that is within 10%, 20%, 30%, 40%, or 50% of the ratio of phosphatidylserine:lyso-phosphatidylinositol in the source cell; or by a ratio of phosphatidylserine:lyso-phosphatidylserine that is within 10%, 20%, 30%, 40%, or 50% of the ratio of phosphatidylserine:lyso-phosphatidylserine in the source cell; or by a ratio of phosphatidylserine:phosphatidate that is within 10%, 20%, 30%, 40%, or 50% of the ratio of phosphatidylserine:phosphatidate in the source cell; or by a ratio of phosphatidylserine:phosphatidylglycerol that is within 10%, 20%, 30%, 40%, or 50% of the ratio of phosphatidylserine:phosphatidylglycerol in the source cell; or by a ratio of phosphatidylserine:phosphatidylinositol that is within 10%, 20%, 30%, 40%, or 50% of the ratio of phosphatidylserine:phosphatidylinositol in the source cell; or by a ratio of phosphatidylserine:cholesterol ester that is within 10%, 20%, 30%, 40%, or 50% of the ratio of phosphatidylserine:cholesterol ester in the source cell; or by a ratio of phosphatidylserine: sphingomyelin that is within 10%, 20%, 30%, 40%, or 50% of the ratio of phosphatidylserine:sphingomyelin in the source cell; or by a ratio of phosphatidylserine: triacylglycerol that is within 10%, 20%, 30%, 40%, or 50% of the ratio of phosphatidylserine:triacylglycerol in the source cell; or by a ratio of sphingomyelin: ceramide that is within 10%, 20%, 30%, 40%, or 50% of the ratio of sphingomyelin:ceramide in the source cell; or by a ratio of sphingomyelin:diacylglycerol that is within 10%, 20%, 30%, 40%, or 50% of the ratio of sphingomyelin:diacylglycerol in the source cell; or by a ratio of sphingomyelin:hexosylceramide that is within 10%, 20%, 30%, 40%, or 50% of the ratio of sphingomyelin:hexosylceramide in the source cell; or by a ratio of sphingomyelin:lysophosphatidate that is within 10%, 20%, 30%, 40%, or 50% of the ratio of sphingomyelin:lysophosphatidate in the source cell; or by a ratio of sphingomyelin:lyso-phosphatidylcholine that is within 10%, 20%, 30%, 40%, or 50% of the ratio of sphingomyelin:lyso-phosphatidylcholine in the source cell; or by a ratio of sphingomyelin:lyso-phosphatidylethanolamine that is within 10%, 20%, 30%, 40%, or 50% of the ratio of sphingomyelin:lyso-phosphatidylethanolamine in the source cell; or by a ratio of sphingomyelin:lyso-phosphatidylglycerol that is within 10%, 20%, 30%, 40%, or 50% of the ratio of sphingomyelin:lyso-phosphatidylglycerol in the source cell; or by a ratio of sphingomyelin:lyso-phosphatidylinositol that is within 10%, 20%, 30%, 40%, or 50% of the ratio of sphingomyelin:lyso-phosphatidylinositol in the source cell; or by a ratio of sphingomyelin:lyso-phosphatidylserine that is within 10%, 20%, 30%, 40%, or 50% of the ratio of sphingomyelin:lyso-phosphatidylserine in the source cell; or by a ratio of sphingomyelin:phosphatidate that is within 10%, 20%, 30%, 40%, or 50% of the ratio of sphingomyelin:phosphatidate in the source cell; or by a ratio of sphingomyelin:phosphatidylglycerol that is within 10%, 20%, 30%, 40%, or 50% of the ratio of sphingomyelin:phosphatidylglycerol in the source cell; or by a ratio of sphingomyelin:phosphatidylinositol that is within 10%, 20%, 30%, 40%, or 50% of the ratio of sphingomyelin:phosphatidylinositol in the source cell; or by a ratio of sphingomyelin:cholesterol ester that is within 10%, 20%, 30%, 40%, or 50% of the ratio of sphingomyelin:cholesterol ester in the source cell; or by a ratio of sphingomyelin:triacylglycerol that is within 10%, 20%, 30%, 40%, or 50% of the ratio of sphingomyelin:triacylglycerol in the source cell; or by a ratio of cholesterol ester:ceramide that is within 10%, 20%, 30%, 40%, or 50% of the ratio of cholesterol ester:ceramide in the source cell; or by a ratio of cholesterol ester:diacylglycerol that is within 10%, 20%, 30%, 40%, or 50% of the ratio of cholesterol ester:diacylglycerol in the source cell; or by a ratio of cholesterol ester:hexosylceramide that is within 10%, 20%, 30%, 40%, or 50% of the ratio of cholesterol ester:hexosylceramide in the source cell; or by a ratio of cholesterol ester:lysophosphatidate that is within 10%, 20%, 30%, 40%, or 50% of the ratio of cholesterol ester:lysophosphatidate in the source cell; or by a ratio of cholesterol ester:lyso-phosphatidylcholine that is within 10%, 20%, 30%, 40%, or 50% of the ratio of cholesterol ester:lyso-phosphatidylcholine in the source cell; or by a ratio of cholesterol ester:lyso-phosphatidylethanolamine that is within 10%, 20%, 30%, 40%, or 50% of the ratio of cholesterol ester:lyso-phosphatidylethanolamine in the source cell; or by a ratio of cholesterol ester:lyso-phosphatidylglycerol that is within 10%, 20%, 30%, 40%, or 50% of the ratio of cholesterol ester:lyso-phosphatidylglycerol in the source cell; or by a ratio of cholesterol ester:lyso-phosphatidylinositol that is within 10%, 20%, 30%, 40%, or 50% of the ratio of cholesterol ester:lyso-phosphatidylinositol in the source cell; or by a ratio of cholesterol ester:lyso-phosphatidylserine that is within 10%, 20%, 30%, 40%, or 50% of the ratio of cholesterol ester:lyso-phosphatidylserine in the source cell; or by a ratio of cholesterol ester:phosphatidate that is within 10%, 20%, 30%, 40%, or 50% of the ratio of cholesterol ester:phosphatidate in the source cell; or by a ratio of cholesterol ester:phosphatidylglycerol that is within 10%, 20%, 30%, 40%, or 50% of the ratio of cholesterol ester:phosphatidylglycerol in the source cell; or by a ratio of cholesterol ester:phosphatidylinositol that is within 10%, 20%, 30%, 40%, or 50% of the ratio of cholesterol ester:phosphatidylinositol in the source cell; or by a ratio of cholesterol ester:triacylglycerol that is within 10%, 20%, 30%, 40%, or 50% of the ratio of cholesterol ester:triacylglycerol in the source cell.

466. The fusosome, fusosome composition, fusosome preparation, or method of any of the preceding embodiments, wherein the fusosome, and/or composition or preparation thereof, is characterized by:
  a) a proteomic composition similar to that of the source cell, e.g., using an assay of Example 42;
  b) ratio of lipids to proteins that is within 10%, 20%, 30%, 40%, or 50% of the corresponding ratio in the source cell, e.g., as measured using an assay of Example 49;
  c) a ratio of proteins to nucleic acids (e.g., DNA or RNA) that is within 10%, 20%, 30%, 40%, or 50% of the corresponding ratio in the source cell, e.g., as measured using an assay of Example 50;
  d) a ratio of proteins to DNA that is greater than the corresponding ratio in the source cell, e.g., at least 10%, 20%, 30%, 40%, 50%, 60%, 70%, 80%, or 90% greater, e.g., as measured using an assay of Example 50;
  e) a ratio of lipids to nucleic acids (e.g., DNA) that is within 10%, 20%, 30%, 40%, or 50% of the corresponding ratio in the source cell, e.g., as measured using an assay of Example 51; and/or
  f) a ratio of lipids to nucleic acids (e.g., DNA) that is greater than the corresponding ratio in the source cell, e.g., at least 10%, 20%, 30%, 40%, 50%, 60%, 70%, 80%, or 90% greater, e.g., as measured using an assay of Example 51.

467. The fusosome, fusosome composition, fusosome preparation, or method of any of the preceding embodiments, wherein the fusosome, and/or composition or preparation thereof, is characterized by:
  a) a half-life in a subject, e.g., in a mouse, that is within 1%, 2%, 3%, 4%, 5%, 10%, 20%, 30%, 40%, 50%, 60%, 70%, 80%, 90%, 100% of the half life of a reference cell, e.g., the source cell, e.g., by an assay of Example 75; or
  b) a half-life in a subject, e.g., in a mouse, that is at least 1 hour, 2 hours, 3 hours, 4 hours, 5 hours, 6 hours, 12 hours, or 24 hours, e.g., in a human subject or in a mouse, e.g., by an assay of Example 75.

468. The fusosome, fusosome composition, fusosome preparation, or method of any of the preceding embodiments, wherein the fusosome, and/or composition or preparation thereof, transports or is capable of transporting glucose (e.g., labeled glucose, e.g., 2-NBDG) across a membrane, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of glucose, e.g., as measured using an assay of Example 64.

469. The fusosome, fusosome composition, fusosome preparation, or method of any of the preceding embodiments, wherein the fusosome, and/or composition or preparation thereof, is characterized by:
  a) esterase activity in the lumen that is within 1%, 2%, 3%, 4%, 5%, 10%, 20%, 30%, 40%, 50%, 60%, 70%, 80%, 90%, or 100% of that of the esterase activity in a reference cell, e.g., the source cell or a mouse embryonic fibroblast, e.g., using an assay of Example 66;
  b) a metabolic activity level (e.g., citrate synthase activity) that is within 1%, 2%, 3%, 4%, 5%, 10%, 20%, 30%, 40%, 50%, 60%, 70%, 80%, 90%, or 100% of the metabolic activity level in a reference cell, e.g., the source cell, e.g., as described in Example 68;

c) a metabolic activity level (e.g., citrate synthase activity) that is at least 1%, 2%, 3%, 4%, 5%, 10%, 20%, 30%, 40%, 50%, 60%, 70%, 80%, 90%, or 100% of the metabolic activity level in a reference cell, e.g., the source cell, e.g., as described in Example 68;

d) a respiration level (e.g., oxygen consumption rate) that is within 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 69;

e) a respiration level (e.g., oxygen consumption rate) that is at least 1%, 2%, 3%, 4%, 5%, 10%, 20%, 30%, 40%, 50%, 60%, 70%, 80%, 90%, or 100% of the respiration level in a reference cell, e.g., the source cell, e.g., as described in Example 69; and/or f) an Annexin-V staining level of at most 18,000, 17,000, 16,000, 15,000, 14,000, 13,000, 12,000, 11,000, or 10,000 MFI, e.g., using an assay of Example 70, or wherein the fusosome comprises an Annexin-V staining level at least 5%, 10%, 20%, 30%, 40%, 50%, 60%, 70%, 80%, or 90% lower than the Annexin-V staining level of otherwise similar fusosomes, or a composition or preparation thereof, treated with menadione in the assay of Example 70.

470. The fusosome, fusosome composition, fusosome preparation, or method of any of the preceding embodiments, wherein the fusosome, and/or composition or preparation thereof, wherein the fusosome comprises an Annexin-V staining level at least 5%, 10%, 20%, 30%, 40%, 50%, 60%, 70%, 80%, or 90% lower than the Annexin-V staining level of a macrophage treated with menadione in the assay of Example 70.

471. The fusosome, fusosome composition, fusosome preparation, or method of any of the preceding embodiments, wherein the fusosome, and/or composition or preparation thereof, is characterized by:

a) a miRNA content level of at least at least 1%, 2%, 3%, 4%, 5%, 10%, 20%, 30%, 40%, 50%, 60%, 70%, 80%, 90%, or greater than that of the source cell, e.g., by an assay of Example 39;

b) a miRNA content level of at least 1%, 2%, 3%, 4%, 5%, 10%, 20%, 30%, 40%, 50%, 60%, 70%, 80%, 90%, or greater of the miRNA content level of the source cell (e.g., up to 100% of the miRNA content level of the source cell), e.g., by an assay of Example 39;

c) a total RNA content level of at least 1%, 2%, 3%, 4%, 5%, 10%, 20%, 30%, 40%, 50%, 60%, 70%, 80%, 90%, or greater of the total RNA content level of the source cell (e.g., up to 100% of the total RNA content level of the source cell), e.g., as measured by an assay of Example 108;

d) a soluble:non-soluble protein ratio is within 1%, 2%, 3%, 4%, 5%, 10%, 20%, 30%, 40%, 50%, 60%, 70%, 80%, 90%, or greater than that of the source cell, e.g., within 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of that of the source cell, e.g., by an assay of Example 47; and/or e) an LPS level less than 5%, 1%, 0.5%, 0.01%, 0.005%, 0.0001%, 0.00001% or less of the lipid content of fusosomes, e.g., as measured by an assay of Example 48.

472. The fusosome, fusosome composition, fusosome preparation, or method of any of the preceding embodiments, wherein the fusosome, and/or composition or preparation thereof, is capable of signal transduction, e.g., transmitting an extracellular signal, e.g., AKT phosphorylation in response to insulin, or glucose (e.g., labeled glucose, e.g., 2-NBDG) uptake in response to insulin, e.g., by at least 1%, 2%, 3%, 4%, 5%, 10%, 20%, 30%, 40%, 50%, 60%, 70%, 80%, 90%, 100% more than a negative control, e.g., an otherwise similar fusosome in the absence of insulin, e.g., using an assay of Example 63.

473. The fusosome, fusosome composition, fusosome preparation, or method of any of the preceding embodiments, wherein the fusosome, and/or composition or preparation thereof, wherein the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, or eye, when administered to a subject, e.g., a mouse, e.g., wherein at least 0.1%, 0.5%, 1%, 1.5%, 2%, 2.5%, 3%, 4%, 5%, 10%, 15%, 20%, 25%, 30%, 35%, 40%, 50%, 60%, 70%, 80%, or 90% of the fusosomes in a population of administered fusosomes are present in the target tissue after 24, 48, or 72 hours, e.g., by an assay of Example 87 or 100.

474. The fusosome, fusosome composition, fusosome preparation, or method of any of the preceding embodiments, wherein the fusosome, and/or composition or preparation thereof, is characterized by:

a) a juxtacrine-signaling level of at least 1%, 2%, 3%, 4%, 5%, 10%, 20%, 30%, 40%, 50%, 60%, 70%, 80%, 90%, or 100% greater than the level of juxtacrine signaling induced by a reference cell, e.g., the source cell or a bone marrow stromal cell (BMSC), e.g., by an assay of Example 71;

b) a juxtacrine-signaling level of at least 1%, 2%, 3%, 4%, 5%, 10%, 20%, 30%, 40%, 50%, 60%, 70%, 80%, or 90% (e.g., up to 100%) of the level of juxtacrine signaling induced by a reference cell, e.g., the source cell or a bone marrow stromal cell (BMSC), e.g., by an assay of Example 71;

c) a paracrine-signaling level of at least 1%, 2%, 3%, 4%, 5%, 10%, 20%, 30%, 40%, 50%, 60%, 70%, 80%, 90%, 100% greater than the level of paracrine signaling induced by a reference cell, e.g., the source cell or a macrophage, e.g., by an assay of Example 72;

d) a paracrine-signaling level of at least 1%, 2%, 3%, 4%, 5%, 10%, 20%, 30%, 40%, 50%, 60%, 70%, 80%, or 90% (e.g., up to 100%) of the level of paracrine signaling induced by a reference cell, e.g., the source cell or a macrophage, e.g., by an assay of Example 72;

e) polymerizing actin at a level within 1%, 2%, 3%, 4%, 5%, 10%, 20%, 30%, 40%, 50%, 60%, 70%, 80%, 90%, or 100% compared to the level of polymerized actin in a reference cell, e.g., the source cell or a C2C12 cell, e.g., by the assay of Example 73; and/or f) a membrane potential within about 1%, 2%, 3%, 4%, 5%, 10%, 20%, 30%, 40%, 50%, 60%, 70%, 80%, 90%, 100% of the membrane potential of a reference cell, e.g., the source cell or a C2C12 cell, e.g., by an assay of Example 74, or wherein provided fusosomes, and/or compositions or preparations thereof, are characterized by a membrane potential of about −20 to −150 mV, −20 to −50 mV, −50 to −100 mV, or −100 to −150 mV, or wherein the fusosome has a membrane potential of less than −1 mv, −5 mv, −10 mv, −20 mv, −30 mv, −40 mv, −50 mv, −60 mv, −70 mv, −80 mv, −90 mv, −100 mv.

475. The fusosome, fusosome composition, fusosome preparation, or method of any of the preceding embodiments, wherein the fusosome, and/or composition or preparation thereof, is capable of extravasation from blood vessels, e.g., at a rate at least 1%, 2%, 5%, 10%, 20%, 30%, 40%, 50%, 60%, 70%, 80%, or 90% the rate of extravasation of the source cell, e.g., using an assay of Example 57, e.g., wherein the source cell is a neutrophil, lymphocyte, B cell, macrophage, or NK cell, optionally wherein provided fusosomes, and/or compositions or preparations thereof, are capable of chemotaxis, e.g., of at least 1%, 2%, 3%, 4%, 5%, 10%, 20%, 30%, 40%, 50%, 60%, 70%, 80%, or 90% (e.g., up to 100%) compared to a reference cell, e.g., a macrophage, e.g., using an assay of Example 58.

476. The fusosome, fusosome composition, fusosome preparation, or method of any of the preceding embodiments, wherein the fusosome, and/or composition or preparation thereof, is capable of phagocytosis, e.g., at least 1%, 2%, 3%, 4%, 5%, 10%, 20%, 30%, 40%, 50%, 60%, 70%, 80%, or 90% (e.g., up to 100%) compared to a reference cell, e.g., a macrophage, e.g., using an assay of Example 60.

477. The fusosome, fusosome composition, fusosome preparation, or method of any of the preceding embodiments, wherein the fusosome, and/or composition or preparation thereof, is capable of crossing a cell membrane, e.g., an endothelial cell membrane or the blood brain barrier.

478. The fusosome, fusosome composition, fusosome preparation, or method of any of the preceding embodiments, wherein the fusosome, and/or composition or preparation thereof, is capable of:

a) secreting a protein, e.g., at a rate at least 1%, 2%, 3%, 4%, 5%, 10%, 20%, 30%, 40%, 50%, 60%, 70%, 80%, 90%, or 100% greater than a reference cell, e.g., a mouse embryonic fibroblast, e.g., using an assay of Example 62; or b) secreting a protein, e.g., at a rate at least 1%, 2%, 3%, 4%, 5%, 10%, 20%, 30%, 40%, 50%, 60%, 70%, 80%, or 90% (e.g., up to 100%) compared to a reference cell, e.g., a mouse embryonic fibroblast, e.g., using an assay of Example 62.

479. The fusosome, fusosome composition, fusosome preparation, or method of any of the preceding embodiments, wherein the fusosome, and/or composition or preparation thereof, is not capable of:

a) transcription or have transcriptional activity of less than 1%, 2.5% 5%, 10%, 20%, 30%, 40%, 50%, 60%, 70%, 80%, or 90% of that of the transcriptional activity of a reference cell, e.g., the source cell, e.g., using an assay of Example 19; or b) nuclear DNA replication or has nuclear DNA replication of less than 1%, 2.5% 5%, 10%, 20%, 30%, 40%, 50%, 60%, 70%, 80%, or 90% of the nuclear DNA replication of a reference cell, e.g., the source cell, e.g., using an assay of Example 20.

480. The fusosome, fusosome composition, fusosome preparation, or method of any of the preceding embodiments, wherein the fusosome, and/or composition or preparation thereof, lacks chromatin or has a chromatin content of less than 1%, 2.5% 5%, 10%, 20%, 30%, 40%, 50%, 60%, 70%, 80%, or 90% of the of the chromatin content of a reference cell, e.g., the source cell, e.g., using an assay of Example 37.

481. The fusosome, fusosome composition, fusosome preparation, or method of any of the preceding embodiments, wherein the fusosome, and/or composition or preparation thereof, meets a pharmaceutical or good manufacturing practices (GMP) standard or was made according to GMP.

482. The fusosome, fusosome composition, fusosome preparation, or method of any of the preceding embodiments, wherein the fusosome, and/or composition or preparation thereof:

a) is characterized by a pathogen level below a predetermined reference value, e.g., are substantially free of pathogens;

b) comprises a contaminant (e.g., nuclear component such as nuclear DNA) level below a predetermined reference value, e.g., are substantially free of one or more specified contaminants; and/or c) is characterized by low immunogenicity, e.g., as described herein.

483. The fusosome, fusosome composition, fusosome preparation, or method of any of the preceding embodiments, wherein the source cell or target cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell), optionally wherein the source cell is other than a 293 cell, HEK cell, human endothelial cell, or a human epithelial cell, monocyte, macrophage, dendritic cell, or stem cell, optionally wherein the source cell or target cell is a white blood cell or a stem cell, optionally wherein the source cell or target cell is selected from a neutrophil, a lymphocyte (e.g., a T cell, a B cell, a natural killer cell), a macrophage, a granulocyte, a mesenchymal stem cell, a bone marrow stem cell, an induced pluripotent stem cell, an embryonic stem cell, or a myeloblast.

484. The fusosome, fusosome composition, fusosome preparation, or method of any of the preceding embodiments, wherein the source cell is:

a) a cell grown under adherent or suspension conditions b) a primary cell, a cultured cell, an immortalized cell, or a cell line (e.g., myelobast cell line, e.g., C2C12);
c) allogeneic, e.g., obtained from a different organism of the same species as the target cell;
d) autologous, e.g., obtained from the same organism as the target cell; or
e) heterologous, e.g., obtained from an organism of a different species from the target cell.

485. The fusosome, fusosome composition, fusosome preparation, or method of any of the preceding embodiments, wherein the source cell comprises a second agent that is exogenous to the source cell, e.g., a therapeutic agent, e.g., a protein or a nucleic acid (e.g., an RNA, e.g., an mRNA or miRNA).

486. The fusosome, fusosome composition, fusosome preparation, or method of embodiment 485, wherein the second agent is present at least, or no more than, 10, 20, 50, 100, 200, 500, 1,000, 2,000, 5,000, 10,000, 20,000, 50,000, 100,000, 200,000, 500,000 or 1,000,000 copies comprised by the fusosome, or is present at an average level of at least, or no more than, 10, 20, 50, 100, 200, 500, 1,000, 2,000, 5,000, 10,000, 20,000, 50,000, 100,000, 200,000, 500,000 or 1,000,000 copies per fusosome.

487. The fusosome, fusosome composition, fusosome preparation, or method of any of the preceding embodiments, wherein the target cell is in an organism, e.g., a primary cell isolated from an organism.

488. The fusosome, fusosome composition, fusosome preparation, or method of any of the preceding embodiments, wherein the targeting domain interacts with a target cell moiety on the target cell, e.g., a cell surface feature.

489. The fusosome, fusosome composition, fusosome preparation, or method of any of the preceding embodiments, wherein the fusosome does not comprise said target cell moiety.

490. The fusosome, fusosome composition, fusosome preparation, or method of any of the preceding embodiments, wherein the fusosome comprises a fusogen which interacts with a fusogen binding partner on the target cell, thereby allowing the fusosome to bind or fuse to the target cell, optionally wherein the fusosome does not comprise said fusogen binding partner.

491. The fusosome, fusosome composition, fusosome preparation, or method of any of the preceding embodiments, wherein the targeting domain is not part of the fusogen or wherein the fusogen comprises the targeting domain.

492. The fusosome, fusosome composition, fusosome preparation, or method of any of the preceding embodiments, wherein the fusogen binding partner is or is a portion of a different entity from the target cell moiety or wherein the fusogen binding partner is or is a portion of the target cell moiety.

493. The fusosome, fusosome composition, fusosome preparation, or method of any of the preceding embodiments, wherein the fusosome enters the target cell by endocytosis, e.g., wherein the level of agent (e.g., membrane payload agent, nuclear payload agent, or organellar payload agent, and optionally a second agent) delivered via an endocytic pathway is 0.01-0.6, 0.01-0.1, 0.1-0.3, or 0.3-0.6, or at least 1%, 2%, 3%, 4%, 5%, 10%, 20%, 30%, 40%, 50%, 60%, 70%, 80%, 90% or greater than a chloroquine treated reference cell contacted with similar fusosomes, e.g., using an assay of Example 91.

494. The fusosome, fusosome composition, fusosome preparation, or method of any of the preceding embodiments, wherein at least 1%, 2%, 3%, 4%, 5%, 10%, 20%, 30%, 40%, 50%, 60%, 70%, 80%, 90% of fusosomes in a fusosome composition or preparation that enter a target cell enter via a non-endocytic pathway, e.g., the fusosomes enter the target cell via fusion with the cell surface, optionally wherein at least 1%, 2%, 3%, 4%, 5%, 10%, 20%, 30%, 40%, 50%, 60%, 70%, 80%, 90% of fusosomes in a fusosome composition or preparation that enter a target cell enter the cytoplasm (e.g., do not enter an endosome or lysosome).

495. The fusosome, fusosome composition, fusosome preparation, or method of any of the preceding embodiments, wherein less than 90%, 80%, 70%, 60%, 50%, 40%, 30%, 20%, 10%, 5%, 4%, 3%, 2%, or 1% of fusosomes in a fusosome composition or preparation that enter a target cell enter an endosome or lysosome.

496. The fusosome, fusosome composition, fusosome preparation, or method of any of the preceding embodiments, wherein the fusosome enters the target cell by a non-endocytic pathway, e.g., wherein the level of agent (e.g., membrane payload agent, nuclear payload agent, or organellar payload agent, and optionally a second agent) delivered is at least 90%, 95%, 98%, or 99% that of a chloroquine treated reference cell, e.g., using an assay of Example 91.

497. The fusosome, fusosome composition, fusosome preparation, or method of any of the preceding embodiments, wherein the fusosome delivers an agent (e.g., membrane payload agent, nuclear payload agent, or organellar payload agent, and optionally a second agent) to a target cell via a dynamin mediated pathway, e.g., wherein the level of agent (e.g., membrane protein payload agent and/or second agent) delivered via a dynamin mediated pathway is in the range of 0.01-0.6, or at least 1%, 2%, 3%, 4%, 5%, 10%, 20%, 30%, 40%, 50%, 60%, 70%, 80%, 90% or greater than Dynasore treated target cells contacted with similar fusosomes, e.g., as measured in an assay of Example 92.

498. The fusosome, fusosome composition, fusosome preparation, or method of any of the preceding embodiments, wherein the fusosome delivers an agent (e.g., membrane payload agent, nuclear payload agent, or organellar payload agent, and optionally a second agent) to a target cell via micropinocytosis, e.g., the level of agent (e.g., membrane payload agent, nuclear payload agent, or organellar payload agent, and optionally a second agent) delivered via macropinocytosis is in the range of 0.01-0.6, or at least 1%, 2%, 3%, 4%, 5%, 10%, 20%, 30%, 40%, 50%, 60%, 70%, 80%, 90% or greater than EIPA treated target cells contacted with similar fusosomes, e.g., as measured in an assay of Example 92.

499. The fusosome, fusosome composition, fusosome preparation, or method of any of the preceding embodiments, wherein the fusosome delivers an agent (e.g., membrane payload agent, nuclear payload agent, or organellar payload agent, and optionally a second agent) to a target cell via an actin-mediated pathway, e.g., wherein a level of agent (e.g., membrane payload agent, nuclear payload agent, or organellar payload agent, and optionally a second agent) delivered via an actin-mediated pathway will be in the range of 0.01-0.6, or at least 1%, 2%, 3%, 4%, 5%, 10%, 20%, 30%, 40%, 50%, 60%, 70%, 80%, 90% or greater than Latrunculin B treated target cells contacted with similar fusosomes, e.g., as measured in an assay of Example 92.

500. The fusosome, fusosome composition, fusosome preparation, or method of any of the preceding embodiments, wherein the fusosome, and/or composition or preparation thereof, has a density of <1, 1-1.1, 1.05-1.15, 1.1-1.2, 1.15-1.25, 1.2-1.3, 1.25-1.35, or >1.35 g/mL, e.g., by an assay of Example 33.

501. The fusosome, fusosome composition, fusosome preparation, or method of any of the preceding embodiments, wherein the fusosome, and/or composition or preparation thereof, comprises less than 0.01%, 0.05%, 0.1%, 0.5%, 1%, 1.5%, 2%, 2.5%, 3%, 4%, 5%, or 10% source cells by protein mass or wherein less than 0.01%, 0.05%, 0.1%, 0.5%, 1%, 1.5%, 2%, 2.5%, 3%, 4%, 5%, or 10% of cells have a functional nucleus.

502. The fusosome, fusosome composition, fusosome preparation, or method of any of the preceding embodiments, wherein at least 10%, 20%, 30%, 40%, 50%, 60%, 70%, 80%, 90%, 95%, or 99% of fusosomes in the fusosome composition or preparation comprise an organelle, e.g., a mitochondrion.

503. The fusosome, fusosome composition, fusosome preparation, or method of any of the preceding embodiments, wherein the fusosome, and/or composition or preparation thereof, comprises a therapeutic agent that is exogenous relative to the source cell.

504. The fusosome, fusosome composition, fusosome preparation, or method of embodiment 503, wherein:
- a) the therapeutic agent is exogenous relative to the target cell; and/or
- b) the exogenous therapeutic agent is chosen from one or more of a protein, e.g., a transmembrane protein, a cell surface protein, a secreted protein, a receptor, an antibody; a nucleic acid, e.g., DNA, a chromosome (e.g. a human artificial chromosome), RNA, mRNA, siRNA, miRNA, or a small molecule.

505. The fusosome, fusosome composition, fusosome preparation, or method of any of the preceding embodiments, wherein the fusosome enters the cell by endocytosis or a non-endocytic pathway.

506. The fusosome, fusosome composition, fusosome preparation, or method of any of the preceding embodiments, wherein the fusosome, and/or composition or preparation thereof, does not comprise a nucleus.

507. The fusosome, fusosome composition, fusosome preparation, or method of any of the preceding embodiments, wherein the fusosome is substantially free of nuclear DNA.

508. The fusosome, fusosome composition, fusosome preparation, or method of any of the preceding embodiments, wherein the fusosome, and/or composition or preparation thereof:
- a) is refrigerated or frozen;
- b) does not comprise a functional nucleus, and/or provided fusosome compositions or preparations comprise one or more fusosomes without a functional nucleus;
- c) comprises less than 0.01%, 0.05%, 0.1%, 0.5%, 1%, 1.5%, 2%, 2.5%, 3%, 4%, 5%, or 10% source cells by protein mass or less than 0.01%, 0.05%, 0.1%, 0.5%, 1%, 1.5%, 2%, 2.5%, 3%, 4%, 5%, or 10% of cells have a functional nucleus;
- d) has been maintained at said temperature for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years; and/or
- e) is characterized by an activity of at least 50%, 60%, 70%, 80%, 90%, 95%, or 99% of the activity of the population before maintenance at said temperature, e.g., by one or more of:
  - i) fusing at a higher rate with a target cell than with a non-target cell, e.g., by at least at least 1%, 2%, 3%, 4%, 5%, 10%, 20%, 30%, 40%, 50%, 60%, 70%, 80%, 90%, e.g., in an assay of Example 54;
  - ii) fusing at a higher rate with a target cell than with other fusosomes, e.g., by at least 10%, 20%, 30%, 40%, 50%, 60%, 70%, 80%, or 90%, e.g., in an assay of Example 54;
  - iii) fusing with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 54; or
  - iv) level of fusogen at a copy number of at least, or no more than, 10, 50, 100, 500, 1,000, 2,000, 5,000, 10,000, 20,000, 50,000, 100,000, 200,000, 500,000 or 1,000,000 copies, e.g., as measured by an assay of Example 29.

509. The fusosome, fusosome composition, fusosome preparation, or method of any of the preceding embodiments, wherein the fusosome, and/or composition or preparation thereof, is stable at a temperature of:
- a) less than 4 C for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years;
- b) less than −20° C. for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years; or
- c) less than −80° C. for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years.

510. The fusosome, fusosome composition, fusosome preparation, or method of any of the preceding embodiments, wherein one or more of the following is true:
- i) the source cell is other than a 293 cell;
- ii) the source cell is not transformed or immortalized;
- iii) the source cell is transformed or immortalized using a method other than adenovirus-mediated immortalization, e.g., immortalized by spontaneous mutation or telomerase expression;
- iv) the fusogen is other than VSVG, a SNARE protein, or a secretory granule protein;
- v) the therapeutic agent is other than Cre or GFP, e.g., EGFP;
- vi) the therapeutic agent is a nucleic acid (e.g., RNA, e.g., mRNA, miRNA, or siRNA) or a protein exogenous to the source cell (e.g., an antibody, e.g., an antibody), e.g., in the lumen; or
- vii) the fusosome does not comprise mitochondria.

511. The fusosome, fusosome composition, fusosome preparation, or method of any of the preceding embodiments, wherein one or more of the following is true:
- i) the source cell is other than a 293 or HEK cell;
- ii) the source cell is not transformed or immortalized;
- iii) the source cell is transformed or immortalized using a method other than adenovirus-mediated immortalization, e.g., immortalized by spontaneous mutation or telomerase expression;

iv) the fusogen is not a viral fusogen; or
v) the fusosome has a diameter of other than between 40 and 150 nm, e.g., greater than 150 nm, 200 nm, 300 n, 400 nm, or 500 nm.

512. The fusosome, fusosome composition, fusosome preparation, or method of any of the preceding embodiments, wherein one or more of the following is true:
i) the membrane protein is expressed by the source cell;
ii) the fusogen is other than TAT, TAT-HA2, HA-2, gp41, Alzheimer's beta-amyloid peptide, a Sendai virus protein, or amphipathic net-negative peptide (WAE 11);
iii) the fusogen is a mammalian fusogen;
iv) the fusosome comprises in its lumen a polypeptide selected from an enzyme, antibody, or anti-viral polypeptide;
v) the fusosome does not comprise a therapeutic transmembrane protein, e.g., a therapeutic transmembrane protein that is exogenous relative to the source cell; or
vi) the fusosome does not comprise CD63 or GLUT4.

513. The fusosome, fusosome composition, fusosome preparation, or method of any of the preceding embodiments, wherein one or more of the following is true:
i) does not comprise a virus, is not infectious, or does not propagate in a host cell;
ii) is not a VLP (virus like particle);
iii) does not comprise a viral structural protein, e.g., a viral capsid protein, e.g., a viral nucleocapsid protein, or wherein the amount of viral capsid protein is less than 10%, 5%, 4%, 3%, 2%, 1%, 0.5%, 0.2%, or 0.1% of total protein, e.g., by an assay of Example 53;
iv) does not comprise a viral matrix protein;
v) does not comprise a viral non-structural protein;
vi) comprises less than 10, 50, 100, 500, 1,000, 2,000, 5,000, 10,000, 20,000, 50,000, 100,000, 200,000, 500,000, 1,000,000, 5,000,000, 10,000,000, 50,000, 000, 100,000,000, 500,000,000, 1,000,000,000 copies per vesicle of a viral structural protein; or
vii) the fusosome is not a virosome.

514. The fusosome, fusosome composition, fusosome preparation, or method of any of the preceding embodiments, wherein the ratio of the copy number of the fusogen to the copy number of viral structural protein on the fusosome is at least 1,000,000:1, 100,000:1, 10,000:1, 1,000:1, 100:1, 50:1 1, 20:1, 10:1, 5:1, or 1:1; or wherein the ratio of the copy number of the fusogen to the copy number of viral matrix protein on the fusosome is at least 1,000,000:1, 100,000:1, 10,000:1, 1,000:1, 100:1, 50:1, 20:1, 10:1, 5:1, or 1:1.

515. The fusosome, fusosome composition, fusosome preparation, or method of any of the preceding embodiments, wherein one or more of the following is true:
i) the fusosome does not comprise a water-immiscible droplet;
ii) the fusosome comprises an aqueous lumen and a hydrophilic exterior;
iii) the fusogen is a protein fusogen.

516. The fusosome, fusosome composition, fusosome preparation, or method of any of the preceding embodiments, wherein one or more of the following is true:
i) the fusogen is a mammalian fusogen or a viral fusogen;
ii) the fusosome was not made by loading the fusosome with a therapeutic or diagnostic substance;
iii) the source cell was not loaded with a therapeutic or diagnostic substance;
iv) the fusosome does not comprise doxorubicin, dexamethasone, cyclodextrin; polyethylene glycol, a micro RNA e.g., miR125, VEGF receptor, ICAM-1, E-selectin, iron oxide, a fluorescent protein e.g., GFP or RFP, a nanoparticle, or an RNase, or does not comprise an exogenous form of any of the foregoing that is exogenous to the source cell; or
v) the fusosome further comprises a therapeutic agent that is exogenous to the source cell, having one or more post-translational modifications, e.g., glycosylation.

517. The fusosome, fusosome composition, fusosome preparation, or method of any of the preceding embodiments, wherein the fusosome is unilamellar or multilamellar.

518. The fusosome, fusosome composition, fusosome preparation, or method of any of the preceding embodiments, wherein the fusosome, fusosome composition, or fusosome preparation is characterized by:
a) a diameter within about 0.01%, 0.05%, 0.1%, 0.5%, 1%, 2%, 3%, 4%, 5%, 10%, 20%, 30%, 40%, 50%, 60%, 70%, 80%, 90%, of that of the source cell, e.g., as measured by an assay of Example 30;
b) a diameter that is less than about 0.01%, 0.05%, 0.1%, 0.5%, 1%, 2%, 3%, 4%, 5%, 10%, 20%, 30%, 40%, 50%, 60%, 70%, 80%, 90%, of that of the source cell, e.g., as measured by an assay of Example 30;
c) a diameter within about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% the diameter of the source cell, e.g., as measured by an assay of Example 30;
d) a diameter that is less than about 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of the diameter of the source cell, e.g., as measured by an assay of Example 30;
e) a diameter that is at least about 10 nm, 20 nm, 30 nm, 40 nm, 50 nm, 60 nm, 70 nm, 80 nm, 90 nm, 100 nm, 150 nm, 200 nm, or 250 nm e.g., as measured by an assay of Example 32;
f) a diameter that is about 10 nm, 20 nm, 30 nm, 40 nm, 50 nm, 60 nm, 70 nm, 80 nm, 90 nm, 100 nm, 150 nm, 200 nm, or 250 nm (e.g., ±20%) e.g., as measured by an assay of Example 32;
g) a diameter that is at least about 500 nm, 750 nm, 1,000 nm, 1,500 nm, 2,000 nm, 2,500 nm, 3,000 nm, 5,000 nm, 10,000 nm, or 20,000 nm, e.g., as measured by an assay of Example 32;
h) a diameter that is about 500 nm, 750 nm, 1,000 nm, 1,500 nm, 2,000 nm, 2,500 nm, 3,000 nm, 5,000 nm, 10,000 nm, or 20,000 nm (e.g., ±20%), e.g., as measured by an assay of Example 32; and/or
i) a diameter that is greater than 5 μm, 6 μm, 7 μm, 8 μm, 10 μm, 20 μm, 50 μm, 100 μm, 150 μm, or 200 μm.

519. The fusosome, fusosome composition, fusosome preparation, or method of any of the preceding embodiments, wherein the fusosome, fusosome composition, or fusosome preparation has a volume that is less than about 0.01%-0.05%, 0.05%-0.1%, 0.1%-0.5%, 0.5%-1%, 1%-2%, 2%-3%, 3%-4%, 4%-5%, 5%-10%, 10%-

20%, 20%-30%, 30%-40%, 40%-50%, 50%-60%, 60%-70%, 70%-80%, or 80%-90%% of the volume of the source cell.

520. The fusosome, fusosome composition, fusosome preparation, or method of any of the preceding embodiments, wherein the fusosome, fusosome composition, or fusosome preparation has a density of other than between 1.08 g/mL and 1.12 g/mL, optionally wherein the density is 1.25 g/mL+/−0.05, e.g., as measured by an assay of Example 33, optionally wherein the density is <1, 1-1.1, 1.05-1.15, 1.1-1.2, 1.15-1.25, 1.2-1.3, 1.25-1.35, or >1.35 g/mL, e.g., by an assay of Example 33.

521. The fusosome, fusosome composition, fusosome preparation, or method of any of the preceding embodiments, wherein one or more of the following is true:

i) the fusosome is not an exosome;

ii) the fusosome is a microvesicle;

iii) the fusosome comprises a non-mammalian fusogen;

iv) the fusosome has been engineered to comprise a fusogen;

v) the fusosome comprises a fusogen that is exogenous relative to the source cell or an overexpressed fusogen;

vi) the fusosome has a diameter of at least 80 nm, 100 nm, 200 nm, 500 nm, 1000 nm, 1200 nm, 1400 nm, or 1500 nm, or a population or plurality of fusosomes has an average diameter of at least 80 nm, 100 nm, 200 nm, 500 nm, 1000 nm, 1200 nm, 1400 nm, or 1500 nm;

vii) the fusosome comprises one or more organelles, e.g., a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule;

viii) the fusosome comprises a cytoskeleton or a component thereof, e.g., actin, Arp2/3, formin, coronin, dystrophin, keratin, myosin, or tubulin;

ix) a preparation comprising a plurality of the fusosomes does not have a flotation density of 1.08-1.22 g/mL, or has a density of at least 1.18-1.25 g/mL, or 1.05-1.12 g/mL, e.g., in a sucrose gradient centrifugation assay, e.g., as described in Thèry et al., "Isolation and characterization of exosomes from cell culture supernatants and biological fluids." Curr Protoc Cell Biol. 2006 April; Chapter 3:Unit 3.22;

x) the lipid bilayer is enriched for ceramides or sphingomyelins or a combination thereof compared to the source cell, or the lipid bilayer is not enriched (e.g., is depleted) for glycolipids, free fatty acids, or phosphatidylserine, or a combination thereof, compared to the source cell;

xi) the fusosome comprises Phosphatidyl serine (PS) or CD40 ligand or both of PS and CD40 ligand, e.g., when measured in an assay of Example 52;

xii) the fusosome is enriched for PS compared to the source cell, e.g., in a population of fusosomes at least 20%, 30%, 40%, 50%, 60%, 70%, 80%, or 90% are positive for PS by an assay of Kanada M, et al. (2015) Differential fates of biomolecules delivered to target cells via extracellular vesicles. Proc Natl Acad Sci USA 112:E1433-E1442;

xiii) the fusosome is substantially free of acetylcholinesterase (AChE), or contains less than 0.001, 0.002, 0.005, 0.01, 0.02, 0.05, 0.1, 0.2, 0.5, 1, 2, 5, 10, 20, 50, 100, 200, 500, or 1000 AChE activity units/μg of protein, e.g., by an assay of Example 67;

xiv) the fusosome is substantially free of a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, or contains less than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is de-enriched for any one or more of these proteins compared to the source cell, or is not enriched for any one or more of these proteins, e.g., by an assay of Example 44;

xv) the fusosome comprises a level of Glyceraldehyde 3-phosphate dehydrogenase (GAPDH) that is below 500, 250, 100, 50, 20, 10, 5, or 1 ng GAPDH/μg total protein or below the level of GAPDH in the source cell, e.g., less than 1%, 2.5%, 5%, 10%, 15%, 20%, 30%, 40%, 50%, 60%, 70%, 80%, or 90%, less than the level of GAPDH per total protein in ng/μg in the source cell, e.g., using an assay of Example 45;

xvi) the fusosome is enriched for one or more endoplasmic reticulum proteins (e.g., calnexin), one or more proteasome proteins, or one or more mitochondrial proteins, or any combination thereof, e.g., wherein the amount of calnexin is less than 500, 250, 100, 50, 20, 10, 5, or 1 ng Calnexin/μg total protein, or wherein the fusosome comprises less Calnexin per total protein in ng/μg compared to the source cell by 1%, 2.5%, 5%, 10%, 15%, 20%, 30%, 40%, 50%, 60%, 70%, 80%, or 90%, e.g., using an assay of Example 46;

xvii) the fusosome comprises an agent (e.g., protein, mRNA, or siRNA) that is exogenous relative to the source cell, e.g., as measured using an assay of Example 39 or 40; or xviii) the fusosome can be immobilized on a mica surface by atomic force microscopy for at least 30 min, e.g., by an assay of Kanada M, et al. (2015) Differential fates of biomolecules delivered to target cells via extracellular vesicles. Proc Natl Acad Sci USA 112:E1433-E1442.

522. The fusosome, fusosome composition, fusosome preparation, or method of any of the preceding embodiments, wherein one or more of the following is true:

i) the fusosome is an exosome;

ii) the fusosome is not a microvesicle;

iii) the fusosome has a diameter of less than 80 nm, 100 nm, 200 nm, 500 nm, 1000 nm, 1200 nm, 1400 nm, or 1500 nm, or a population of fusosomes has an average diameter of at least 80 nm, 100 nm, 200 nm, 500 nm, 1000 nm, 1200 nm, 1400 nm, or 1500 nm;

iv) the fusosome does not comprise an organelles;

v) the fusosome does not comprise a cytoskeleton or a component thereof, e.g., actin, Arp2/3, formin, coronin, dystrophin, keratin, myosin, or tubulin;

vi) a preparation comprising a plurality of the fusosomes has a flotation density of 1.08-1.22 g/mL, e.g., in a sucrose gradient centrifugation assay, e.g., as described in Thèry et al., "Isolation and characterization of exosomes from cell culture supernatants and biological fluids." Curr Protoc Cell Biol. 2006 April; Chapter 3:Unit 3.22;

vii) the lipid bilayer is not enriched (e.g., is depleted) for ceramides or sphingomyelins or a combination thereof compared to the source cell, or the lipid bilayer is enriched for glycolipids, free fatty acids, or phosphatidylserine, or a combination thereof, compared to the source cell;

viii) the fusosome does not comprise, or is depleted for relative to the source cell, Phosphatidyl serine (PS) or CD40 ligand or both of PS and CD40 ligand, e.g., when measured in an assay of Example 52;

ix) the fusosome is not enriched (e.g., is depleted) for PS compared to the source cell, e.g., in a population of fusosomes less than 20%, 30%, 40%, 50%, 60%, 70%, 80%, or 90% are positive for PS by an assay of Kanada M, et al. (2015) Differential fates of biomolecules delivered to target cells via extracellular vesicles. Proc Natl Acad Sci USA 112:E1433-E1442;

x) the fusosome comprises acetylcholinesterase (AChE), e.g. at least 0.001, 0.002, 0.005, 0.01, 0.02, 0.05, 0.1, 0.2, 0.5, 1, 2, 5, 10, 20, 50, 100, 200, 500, or 1000 AChE activity units/μg of protein, e.g., by an assay of Example 67;

xi) the fusosome comprises a Tetraspanin family protein (e.g., CD63, CD9, or CD81), an ESCRT-related protein (e.g., TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72), or any combination thereof, e.g., contains more than 0.05%, 0.1%, 0.5%, 1%, 2%, 3%, 4%, 5%, 5%, or 10% of any individual exosomal marker protein and/or less than 0.05%, 0.1%, 0.5%, 1%, 2%, 3%, 4%, 5%, 10%, 15%, 20%, or 25% of total exosomal marker proteins of any of said proteins, or is enriched for any one or more of these proteins compared to the source cell, e.g., by an assay of Example 44;

xii) the fusosome comprises a level of Glyceraldehyde 3-phosphate dehydrogenase (GAPDH) that is above 500, 250, 100, 50, 20, 10, 5, or 1 ng GAPDH/μg total protein or below the level of GAPDH in the source cell, e.g., at least 1%, 2.5%, 5%, 10%, 15%, 20%, 30%, 40%, 50%, 60%, 70%, 80%, or 90%, greater than the level of GAPDH per total protein in ng/μg in the source cell, e.g., using an assay of Example 45;

xiii) the fusosome is not enriched for (e.g., is depleted for) one or more endoplasmic reticulum proteins (e.g., calnexin), one or more proteasome proteins, or one or more mitochondrial proteins, or any combination thereof, e.g., wherein the amount of calnexin is less than 500, 250, 100, 50, 20, 10, 5, or 1 ng Calnexin/μg total protein, or wherein the fusosome comprises less Calnexin per total protein in ng/μg compared to the source cell by 1%, 2.5%, 5%, 10%, 15%, 20%, 30%, 40%, 50%, 60%, 70%, 80%, or 90%, e.g., using an assay of Example 46; or xiv) the fusosome can not be immobilized on a mica surface by atomic force microscopy for at least 30 min, e.g., by an assay of Kanada M, et al. (2015) Differential fates of biomolecules delivered to target cells via extracellular vesicles. Proc Natl Acad Sci USA 112:E1433-E1442.

523. The fusosome, fusosome composition, fusosome preparation, or method of any of the preceding embodiments, wherein one or more of the following is true:

i) the fusosome does not comprise a VLP;

ii) the fusosome does not comprise a virus;

iii) the fusosome does not comprise a replication-competent virus;

iv) the fusosome does not comprise a viral protein, e.g., a viral structural protein, e.g., a capsid protein or a viral matrix protein;

v) the fusosome does not comprise a capsid protein from an enveloped virus;

vi) the fusosome does not comprise a nucleocapsid protein; or vii) the fusogen is not a viral fusogen.

524. The fusosome, fusosome composition, fusosome preparation, or method of any of the preceding embodiments, wherein the fusosome comprises cytosol.

525. The fusosome, fusosome composition, fusosome preparation, or method of any of the preceding embodiments, wherein the fusosome comprises or is comprised by a cytobiologic.

526. The fusosome, fusosome composition, fusosome preparation, or method of any of the preceding embodiments, wherein the fusosome comprises or is comprised by an enucleated cell.

527. The fusosome, fusosome composition, fusosome preparation, or method of any of the preceding embodiments, wherein the fusosome comprises or is comprised by a chondrisome.

528. The fusosome, fusosome composition, fusosome preparation, or method of any of the preceding embodiments, wherein one or more of the following is true:

i) the fusosome or the source cell does not form a teratoma when implanted into subject, e.g., by an assay of Example 102;

ii) the fusosome and/or compositions or preparations thereof, are capable of chemotaxis, e.g., of within 1%, 2%, 3%, 4%, 5%, 10%, 20%, 30%, 40%, 50%, 60%, 70%, 80%, 90%, 100% or greater than a reference cell, e.g., a macrophage, e.g., using an assay of Example 58;

iii) the fusosome and/or compositions or preparations thereof, are capable of homing, e.g., at the site of an injury, wherein the cytobiologic is from a human cell, e.g., using an assay of Example 59, e.g., wherein the source cell is a neutrophil; or iv) the fusosome and/or compositions or preparations thereof, are capable of phagocytosis, e.g., wherein phagocytosis by the fusosome is detectable within 0.5, 1, 2, 3, 4, 5, or 6 hours in using an assay of Example 60, e.g., wherein the source cell is a macrophage.

529. The fusosome, fusosome composition, fusosome preparation, or method of any of the preceding embodiments, wherein the fusosome, fusosome composition, or fusosome preparation retains one, two, three, four, five six or more of any of the characteristics for 5 days or less, e.g., 4 days or less, 3 days or less, 2 days or less, 1 day or less, e.g., about 12-72 hours, after administration into a subject, e.g., a human subject.

530. The fusosome, fusosome composition, fusosome preparation, or method of any of the preceding embodiments, wherein the fusosome has one or more of the following characteristics:

a) comprises one or more endogenous proteins from a source cell, e.g., membrane proteins or cytosolic proteins;

b) comprises at least 10, 20, 50, 100, 200, 500, 1000, 2000, or 5000 different proteins; c) comprises at least 1, 2, 5, 10, 20, 50, or 100 different glycoproteins;

d) at least 10%, 20%, 30%, 40%, 50%, 60%, 70%, 80%, or 90% by mass of the proteins in the fusosome are naturally-occurring proteins;

e) comprises at least 10, 20, 50, 100, 200, 500, 1000, 2000, or 5000 different RNAs; or f) comprises at least 2, 3, 4, 5, 10, or 20 different lipids, e.g., selected from CL, Cer, DAG, HexCer, LPA, LPC, LPE, LPG, LPI, LPS, PA, PC, PE, PG, PI, PS, CE, SM and TAG.

531. The fusosome, fusosome composition, fusosome preparation, or method of any of the preceding embodiments, wherein the fusosome has been manipulated to have, or the fusosome is not a naturally occurring cell and has, or wherein the nucleus does not naturally have one, two, three, four, five or more of the following properties:

a) the partial nuclear inactivation results in a reduction of at least 50%, 60%, 70%, 80%, 90% or more in nuclear function, e.g., a reduction in transcription or DNA replication, or both, e.g., wherein transcription is measured by an assay of Example 19 and DNA replication is measured by an assay of Example 20;

b) the fusosome is not capable of transcription or has transcriptional activity of less than 1%, 2.5% 5%, 10%, 20%, 30%, 40%, 50%, 60%, 70%, 80%, or 90% of that of the transcriptional activity of a reference cell, e.g., the source cell, e.g., using an assay of Example 19;

c) the fusosome is not capable of nuclear DNA replication or has nuclear DNA replication of less than 1%, 2.5% 5%, 10%, 20%, 30%, 40%, 50%, 60%, 70%, 80%, or 90% of the nuclear DNA replication of a reference cell, e.g., the source cell, e.g., using an assay of Example 20;

d) the fusosome lacks chromatin or has a chromatin content of less than 1%, 2.5% 5%, 10%, 20%, 30%, 40%, 50%, 60%, 70%, 80%, or 90% of the of the chromatin content of a reference cell, e.g., the source cell, e.g., using an assay of Example 37;

e) the fusosome lacks a nuclear membrane or has less than 50%, 40%, 30%, 20%, 10%, 5%, 4%, 3%, 2%, or 1% the amount of nuclear membrane of a reference cell, e.g., the source cell or a Jurkat cell, e.g., by an assay of Example 36;

f) the fusosome lacks functional nuclear pore complexes or has reduced nuclear import or export activity, e.g., by at least 50%, 40%, 30%, 20%, 10%, 5%, 4%, 3%, 2%, or 1% by an assay of Example 36, or the fusosome lacks on or more of a nuclear pore protein, e.g., NUP98 or Importin 7.

g) the fusosome does not comprise histones or has histone levels less than 1%, 2%, 3%, 4%, 5%, 10%, 20%, 30%, 40%, 50%, 60%, 70%, 80%, or 90% of the histone level of the source cell (e.g., of H1, H2a, H2b, H3, or H4), e.g., by an assay of Example 37;

h) the fusosome comprises less than 20, 10, 5, 4, 3, 2, or 1 chromosome;

i) nuclear function is eliminated;

j) the fusosome is an enucleated mammalian cell;

k) the nucleus is removed or inactivated, e.g., extruded by mechanical force, by radiation or by chemical ablation; or l) the fusosome is from a mammalian cell having DNA that is completely or partially removed, e.g., during interphase or mitosis.

532. The fusosome, fusosome composition, fusosome preparation, or method of any of the preceding embodiments, wherein fusosome comprises mtDNA or vector DNA, e.g., wherein the fusosome does not comprise DNA, or is substantially free of DNA.

533. The fusosome, fusosome composition, fusosome preparation, or method of any of the preceding embodiments, wherein the source cell is a primary cell, immortalized cell or a cell line (e.g., myelobast cell line, e.g., C2C12).

534. The fusosome, fusosome composition, fusosome preparation, or method of any of the preceding embodiments, wherein the fusosome is from a source cell having a modified genome, e.g., having reduced immunogenicity (e.g., by genome editing, e.g., to remove an MHC protein, e.g., MHC complex).

535. The fusosome, fusosome composition, fusosome preparation, or method of any of the preceding embodiments, wherein the source cell is from a cell culture treated with an immunosuppressive agent.

536. The fusosome, fusosome composition, fusosome preparation, or method of any of the preceding embodiments, wherein the source cell is substantially non-immunogenic, e.g., using an assay described herein 537. The fusosome, fusosome composition, fusosome preparation, or method of any of the preceding embodiments, wherein the source cell comprises an exogenous agent, e.g., a therapeutic agent.

538. The fusosome, fusosome composition, fusosome preparation, or method of any of the preceding embodiments, wherein the source cell is a recombinant cell.

539. The fusosome, fusosome composition, fusosome preparation, or method of any of the preceding embodiments, wherein the source cell is from a cell culture treated with an anti-inflammatory signal.

540. The fusosome, fusosome composition, fusosome preparation, or method of any of the preceding embodiments, wherein the fusosome further comprises an agent that is exogenous relative to the source cell, e.g., a therapeutic membrane payload agent, nuclear payload agent, or organellar payload agent, e.g., a protein or a nucleic acid (e.g., a DNA, a chromosome (e.g. a human artificial chromosome), an RNA, e.g., an mRNA or miRNA); e.g., wherein the exogenous agent is present at at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies.

541. The fusosome, fusosome composition, fusosome preparation, or method of embodiment 381, wherein the fusosome has an altered, e.g., increased or decreased level of one or more endogenous molecule, e.g., protein or nucleic acid (e.g., in some embodiments, endogenous relative to the source cell, and in some embodiments, endogenous relative to the target cell), e.g., due to treatment of the source cell, e.g., mammalian source cell with a siRNA or gene editing enzyme.

542. The fusosome, fusosome composition, fusosome preparation, or method of embodiment 540 or 541, wherein the endogenous molecule is:

a) present at at least, or no more than, 10, 20, 50, 100, 200, 500, 1,000, 2,000, 5,000, 10,000, 20,000, 50,000, 100,000, 200,000, 500,000, 1,000,000, 5,000,000, 10,000,000, 50,000,000, 100,000,000, 500,000,000, or 1,000,000,000 copies;

b) present at a concentration of at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, $1.0\times10^7$, $5.0\times10^7$, or $1.0\times10^8$, greater than its concentration in the source cell;

c) present at a concentration of at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, $1.0\times10^7$, $5.0\times10^7$, or $1.0\times10^8$ less than its concentration in the source cell.

543. The fusosome, fusosome composition, fusosome preparation, or method of any of the preceding embodiments, wherein the fusogen:

a) is a viral fusogen, e.g., HA, HIV-1 ENV, gp120, or VSV-G;

b) is a mammalian fusogen, e.g., a SNARE, a Syncytin, myomaker, myomixer, myomerger, or FGFRL1;

c) is active at a pH of 4-5, 5-6, 6-7, 7-8, 8-9, or 9-10;

d) is not active at a pH of 4-5, 5-6, 6-7, 7-8, 8-9, or 9-10;

e) fuses to a target cell at the surface of the target cell;

f) promotes fusion in a lysosome-independent manner;

g) is a protein fusogen;

h) is a lipid fusogen, e.g., oleic acid, glycerol monooleate, a glyceride, diacylglycerol, or a modified unsaturated fatty acid;

i) is a chemical fusogen, e.g., PEG; optionally wherein the fusogen is a small molecule fusogen, e.g., halothane, an NSAID such as meloxicam, piroxicam, tenoxicam, and chlorpromazine;

j) is recombinant;

k) is biochemically incorporated, e.g., the fusogen is provided as a purified protein and contacted with a lipid bilayer under conditions that allow for associate of the fusogen with the lipid bilayer; and/or l) is biosynthetically incorporated, e.g. expressed in a source cell under conditions that allow the fusogen to associate with the lipid bilayer.

544. The fusosome, fusosome composition, fusosome preparation, or method of any of the preceding embodiments, wherein the fusogen binds a target cell, e.g., a target cell other than a HeLa cell, e.g., a target cell that is not transformed or immortalized.

545. The fusosome, fusosome composition, fusosome preparation, or method of embodiment 544, wherein the cell that is not transformed displays contact inhibition and/or its growth is dependent on the same survival factors or growth factors as a normal cell of the same type.

546. The fusosome composition or fusosome preparation of any of the preceding embodiments, wherein the plurality of fusosomes are the same, or are different.

547. The fusosome composition or fusosome preparation of embodiment 546, wherein the plurality of fusosomes are:

a) from one, two or more types of source cells; and/or b) the same if at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% of the fusosomes in the fusosome composition share at least one property selected from: comprise the same fusogen; produced using the same type of source cell; or comprise the same payload (e.g., membrane payload agent, nuclear payload agent, or organellar payload agent).

548. The fusosome composition or fusosome preparation of embodiment 546 or 547, wherein:

a) at least 50%, 60%, 70%, 80%, 90%, 95%, or 99% of fusosomes in the plurality have a diameter within 10%, 20%, 30%, 40%, or 50% of the mean diameter of the fusosomes in the fusosome composition or preparation; or b) at least 50%, 60%, 70%, 80%, 90%, 95%, or 99% of fusosomes in the plurality have a volume within 10%, 20%, 30%, 40%, or 50% of the mean volume of the fusosomes in the fusosome composition or preparation.

549. The fusosome composition or fusosome preparation of any of embodiments 546-548, wherein the fusosome composition or preparation has less than about 90%, 80%, 70%, 60%, 50%, 40%, 30%, 20%, 10%, 5%, variability in diameter distribution within 10%, 50%, or 90% of the source cell population variability in diameter distribution, e.g., based on Example 31.

550. The fusosome composition or fusosome preparation of any of embodiments 546-549, wherein at least 50%, 60%, 70%, 80%, 90%, 95%, or 99% of fusosomes in the plurality have a copy number of the fusogen within 10%, 20%, 30%, 40%, 50%, 60%, 70%, 80%, or 90% of the mean fusogen copy number in the fusosomes in the fusosome composition or preparation.

551. The fusosome composition or fusosome preparation of any of embodiments 546-550, wherein at least 50%, 60%, 70%, 80%, 90%, 95%, or 99% of fusosomes in the plurality have a copy number of the therapeutic agent within 10%, 20%, 30%, 40%, 50%, 60%, 70%, 80%, or 90% of the mean therapeutic agent copy number in the fusosomes in the fusosome composition or preparation.

552. The fusosome composition or fusosome preparation of any of embodiments 546-551, wherein the fusosome composition or preparation comprises at least 105, 106, 107, 108, 109, or 1010 or fusosomes. In some embodiments, the fusosome composition or preparation is in a volume of at least 1 μL, 2 μL, 5 μL, 10 μL, 20 μL, 50 μL, 100 μL, 200 μL, 500 μL, 1 mL, 2 mL, 5 mL, or 10 mL.

553. The fusosome composition or fusosome preparation of any of the preceding embodiments, wherein the plurality of fusosomes comprises at least 0.01%-0.05%, 0.05%-0.1%, 0.1%-0.5%, 0.5%-1%, 1%-2%, 2%-3%, 3%-4%, 4%-5%, 5%-10%, 10%-20%, 20%-30%, 30%-40%, 40%-50%, 50%-60%, 60%-70%, 70%-80%, or 80%-90% fusosomes which have one or more of the following characteristics:

(i) do not comprise a nucleus or a functional nucleus;

(ii) are substantially free of nuclear DNA; or (iii) do not comprise mitochondria or functional mitochondria.

554. The pharmaceutical composition of any of the preceding embodiments, wherein one or more of the following is true:

a) the pharmaceutical composition meets a pharmaceutical or good manufacturing practices (GMP) standard;

b) the pharmaceutical composition was made according to good manufacturing practices (GMP);

c) the pharmaceutical composition has a pathogen level below a predetermined reference value, e.g., is substantially free of pathogens;

d) the pharmaceutical composition has a contaminant level (e.g., nuclear DNA) below a predetermined reference value, e.g., is substantially free of contaminants; or e) the pharmaceutical composition has low immunogenicity, e.g., as described herein.

555. The fusosome, fusosome composition, fusosome preparation, or method of any of the preceding embodiments, wherein the biological function is selected from:

a) modulating, e.g., inhibiting or stimulating, an enzyme;

b) modulating, e.g., increasing or decreasing levels of, a molecule (e.g., a protein, nucleic acid, or metabolite, drug, or toxin) in the subject, e.g., by inhibiting or stimulating synthesis or by inhibiting or stimulating degradation of the factor;

c) modulating, e.g., increasing or decreasing, viability of a target cell or tissue; or d) modulating a protein state, e.g., increasing or decreasing phosphorylation of the protein, or modulating the protein conformation;

e) promoting healing of an injury;

f) modulating, e.g., increasing or decreasing, an interaction between two cells;

g) modulating, e.g., promoting or inhibiting, cell differentiation;

h) altering distribution of a factor (e.g., a protein, nucleic acid, metabolite, drug, or toxin) in the subject;

i) modulating, e.g. increasing or decreasing, an immune response; or j) modulating, e.g. increasing or decreasing, recruitment of cells to a target tissue.

556. The fusosome, fusosome composition, fusosome preparation, or method of any of the preceding embodiments, wherein the subject has a cancer, an inflammatory disorder, autoimmune disease, a chronic disease, inflammation, damaged organ function, an infectious disease, metabolic disease, degenerative disorder, genetic disease (e.g., a genetic deficiency or a dominant genetic disorder), or an injury.

557. The fusosome, fusosome composition, fusosome preparation, or method of any of the preceding embodiments, wherein the subject has an infectious disease and the fusosome comprises an antigen for the infectious disease.

558. The fusosome, fusosome composition, fusosome preparation, or method of any of the preceding embodiments, wherein the subject has a genetic deficiency and the fusosome comprises a protein for which the subject is deficient, or a nucleic acid (e.g., a DNA, a gDNA, a cDNA, an RNA, a pre-mRNA, an mRNA, etc.) encoding the protein, or a DNA encoding the protein, or a chromosome encoding the protein, or a nucleus comprising a nucleic acid encoding the protein.

559. The fusosome, fusosome composition, fusosome preparation, or method of any of the preceding embodiments, wherein the subject has a dominant genetic disorder, and the fusosome comprises a nucleic acid inhibitor (e.g., siRNA or miRNA) of the dominant mutant allele.

560. The fusosome, fusosome composition, fusosome preparation, or method of any of the preceding embodiments, wherein the subject has a dominant genetic disorder, and the fusosome comprises a nucleic acid inhibitor (e.g., siRNA or miRNA) of the dominant mutant allele, and the fusosome also comprises an mRNA encoding a non-mutated allele of the mutated gene that is not targeted by the nucleic acid inhibitor.

561. The fusosome, fusosome composition, fusosome preparation, or method of any of the preceding embodiments, wherein the subject is in need of vaccination and/or is in need of regeneration, e.g., of an injured site.

562. The fusosome, fusosome composition, fusosome preparation, or method of any of the preceding embodiments, wherein the fusosome comprises a nucleic acid which further comprises one or more sequences encoding one or more signal sequences, e.g., wherein a target cell translocates a protein comprising a signal sequence to the cell membrane of the target cell.

563. The fusosome, fusosome composition, fusosome preparation, or method of any of the preceding embodiments, wherein the fusosome composition or preparation is:

a) administered to the subject at least 1, 2, 3, 4, or 5 times;

b) administered to the subject systemically (e.g., orally, parenterally, subcutaneously, intravenously, intramuscularly, intraperitoneally) or locally;

c) administered to the subject such that the fusosome composition or preparation reaches a target tissue selected from liver, lungs, heart, spleen, pancreas, gastrointestinal tract, kidney, testes, ovaries, brain, reproductive organs, central nervous system, peripheral nervous system, skeletal muscle, endothelium, inner ear, or eye;

d) co-administered with an immunosuppressive agent, e.g., a glucocorticoid, cytostatic, antibody, or immunophilin modulator; and/or e) co-administered with an immunostimulatory agent, e.g., an adjuvant, interleukin, cytokine, or chemokine.

564. The fusosome, fusosome composition, fusosome preparation, or method of any of the preceding embodiments, wherein administration of the fusosome composition or preparation results in upregulation or downregulation of a gene in a target cell in the subject, e.g., wherein the fusosome comprises a transcriptional activator or repressor, a translational activator or repressor, or an epigenetic activator or repressor.

565. The fusosome, fusosome composition, fusosome preparation, or method of any of the preceding embodiments, wherein the fusosome preparation comprises:

a) at least 105, 106, 107, 108, 109, 1010, 1011, 1012, 1013, 1014, or 1015 fusosomes; and/or b) at least 10 mL, 20 mL, 50 mL, 100 mL, 200 mL, 500 mL, 1 L, 2 L, 5 L, 10 L, 20 L, or 50 L total volume.

566. The fusosome, fusosome composition, fusosome preparation, or method of any of the preceding embodiments, wherein the first fusogen is not a lipopeptide.

567. The fusosome, fusosome composition, fusosome preparation, or method of any of the preceding embodiments, wherein the fusosome, fusosome composition, or fusosome preparation has partial or complete nuclear inactivation (e.g., nuclear removal).

568. The fusosome, fusosome composition, fusosome preparation, or method of any of the preceding embodiments, wherein the source cell is:

a) a cell grown under adherent or suspension conditions;

b) a primary cell, a cultured cell, an immortalized cell, or a cell line (e.g., myelobast cell line, e.g., C2C12);
c) allogeneic, e.g., obtained from a different organism of the same species as the target cell;
d) heterologous, e.g., obtained from an organism of a different species from the target cell.

569. The fusosome, fusosome composition, fusosome preparation, or method of any of the preceding embodiments, wherein the fusosome is not captured by:
a) the scavenger system in circulation or by Kupffer cells in the sinus of the liver; or
b) the reticulo-endothelial system (RES) in a subject, e.g., by an assay of Example 76.

570. The fusosome, fusosome composition, fusosome preparation, or method of any of the preceding embodiments, wherein when a plurality of fusosomes are administered to a subject, less than 1%, 2%, 3%, 4%, 5%, 10%, 20%, 30%, 40%, 50%, 60%, 70%, 80%, 90%, of the plurality are not captured by the RES after 24 hours, e.g., by an assay of Example 76.

571. The fusosome, fusosome composition, fusosome preparation, or method of any of the preceding embodiments, wherein the fusosome comprises a viral structural protein and/or a viral matrix protein.

572. The fusosome, fusosome composition, fusosome preparation, or method of any of the preceding embodiments, wherein the fusosome is substantially free of, or has a lower number of one or more of the following organelles: a mitochondrion, Golgi apparatus, lysosome, endoplasmic reticulum, vacuole, endosome, acrosome, autophagosome, centriole, glycosome, glyoxysome, hydrogenosome, melanosome, mitosome, cnidocyst, peroxisome, proteasome, vesicle, and stress granule, e.g., as compared to the source cell.

573. The fusosome, fusosome composition, fusosome preparation, or method of any of the preceding embodiments, wherein the fusosome does not comprise Cre or GFP, e.g., EGFP.

574. The fusosome, fusosome composition, fusosome preparation, or method of any of the preceding embodiments, wherein the fusosome composition or pharmaceutical composition has been maintained at a predetermined temperature for at least 1, 2, 3, 6, or 12 hours; 1, 2, 3, 4, 5, or 6 days; 1, 2, 3, or 4 weeks; 1, 2, 3, or 6 months; or 1, 2, 3, 4, or 5 years; and/or wherein the predetermined temperature is selected from about 4, 0, −4, −10, −12, −16, −20, −80, or −160° C.

575. The fusosome, fusosome composition, fusosome preparation, or method of any of the preceding embodiments, wherein the fusosome composition or pharmaceutical composition, has an activity of at least 50%, 60%, 70%, 80%, 90%, 95%, or 99% of the activity of the plurality before maintenance at said temperature, e.g., by one or more of:
i) the fusosome fuses at a higher rate with a target cell than with a non-target cell, e.g., by at least at least 10%, e.g., in an assay of Example 54;
ii) the fusosome fuses at a higher rate with a target cell than with other fusosomes, e.g., by at least 50%, e.g., in an assay of Example 54;
iii) the fusosome fuses with target cells at a rate such that an agent in the fusosome is delivered to at least 10% of target cells after 24 hours, e.g., in an assay of Example 54; or
iv) the fusogen is present at a copy number of at least 50%, 60%, 70%, 80%, 90%, 95%, or 99% of the fusogen copy number of the plurality before maintenance at said temperature, e.g., as measured by an assay of Example 29.

576. The fusosome, fusosome composition, fusosome preparation, or method of any of the preceding embodiments, wherein the fusosome composition or pharmaceutical composition is considered stable if it has an activity of at least 50%, 60%, 70%, 80%, 90%, 95%, or 99% of the activity of the plurality before storage at said temperature for said time period, e.g., by one or more of:
i) the fusosome fuses at a higher rate with a target cell than with a non-target cell, e.g., by at least at least 10%, e.g., in an assay of Example 54;
ii) the fusosome fuses at a higher rate with a target cell than with other fusosomes, e.g., by at least 50%, e.g., in an assay of Example 54;
iii) the fusosome fuses with target cells at a rate such that an agent in the fusosome is delivered to at least 10% of target cells after 24 hours, e.g., in an assay of Example 54; or
iv) the fusogen is present at a copy number of at least 50%, 60%, 70%, 80%, 90%, 95%, or 99% of the fusogen copy number of the plurality before maintenance at said temperature, e.g., as measured by an assay of Example 29.

577. The fusosome, fusosome composition, fusosome preparation, or method of any of the preceding embodiments, wherein the disease or disorder is selected from cancer, autoimmune disorder, or infectious disease.

578. The fusosome, fusosome composition, fusosome preparation, or method of any of the preceding embodiments, wherein the fusosome comprises a neoantigen.

579. The fusosome, fusosome composition, fusosome preparation, or method of any of the preceding embodiments, wherein the fusosome composition is administered:
a) to the subject at least 1, 2, 3, 4, or 5 times;
b) to the subject systemically (e.g., orally, parenterally, subcutaneously, intravenously, intramuscularly, intraperitoneally) or locally; and/or
c) to the subject such that the fusosome composition reaches a target tissue selected from liver, lungs, heart, spleen, pancreas, gastrointestinal tract, kidney, testes, ovaries, brain, reproductive organs, central nervous system, peripheral nervous system, skeletal muscle, endothelium, inner ear, or eye.

580. The fusosome, fusosome composition, fusosome preparation, or method of any of the preceding embodiments, wherein the fusosome composition is co-administered with:
a) an immunosuppressive agent, e.g., a glucocorticoid, cytostatic, antibody, or immunophilin modulator; and/or
b) an immunostimulatory agent, e.g., an adjuvant, interleukin, cytokine, or chemokine.

581. The fusosome, fusosome composition, fusosome preparation, or method of any of the preceding embodiments, wherein the plurality of fusosomes has a local, distal, or systemic effect.

582. The fusosome, fusosome composition, fusosome preparation, or method of any of the preceding embodiments, wherein the organism is a human, e.g., wherein the human has a disease, disorder, or condition.

583. The fusosome, fusosome composition, fusosome preparation, or method of embodiment 582, wherein presence of the membrane payload agent, nuclear payload agent, or organellar payload agent in the cell membrane lipid bilayer of the target cell improves one or more symptoms of the disease, disorder, or condition.

Any of the aspects herein, e.g., the fusosomes, fusosome compositions, preparations and methods above, can be combined with one or more of the embodiments herein, e.g., one or of the embodiments described herein.

Other features, objects, and advantages of the invention will be apparent from the description and drawings, and from the claims.

Unless otherwise defined, all technical and scientific terms used herein have the same meaning as commonly understood by one of ordinary skill in the art to which this invention belongs. All publications, patent applications, patents, and other references mentioned herein are incorporated by reference in their entirety. For example, all GenBank, Unigene, and Entrez sequences referred to herein, e.g., in any Table herein, are incorporated by reference. Unless otherwise specified, the sequence accession numbers specified herein, including in any Table herein, refer to the database entries current as of Feb. 17, 2018. When one gene or protein references a plurality of sequence accession numbers, all of the sequence variants are encompassed. In addition, the materials, methods, and examples are illustrative only and not intended to be limiting.

BRIEF DESCRIPTION OF THE DRAWINGS

The following detailed description of the invention will be better understood when read in conjunction with the appended drawings. For the purpose of illustrating the invention, there are shown in the drawings described herein certain embodiments, which are presently exemplified. It should be understood, however, that the invention is not limited to the precise arrangement and instrumentalities of the embodiments shown in the drawings.

DETAILED DESCRIPTION

Figure 1:
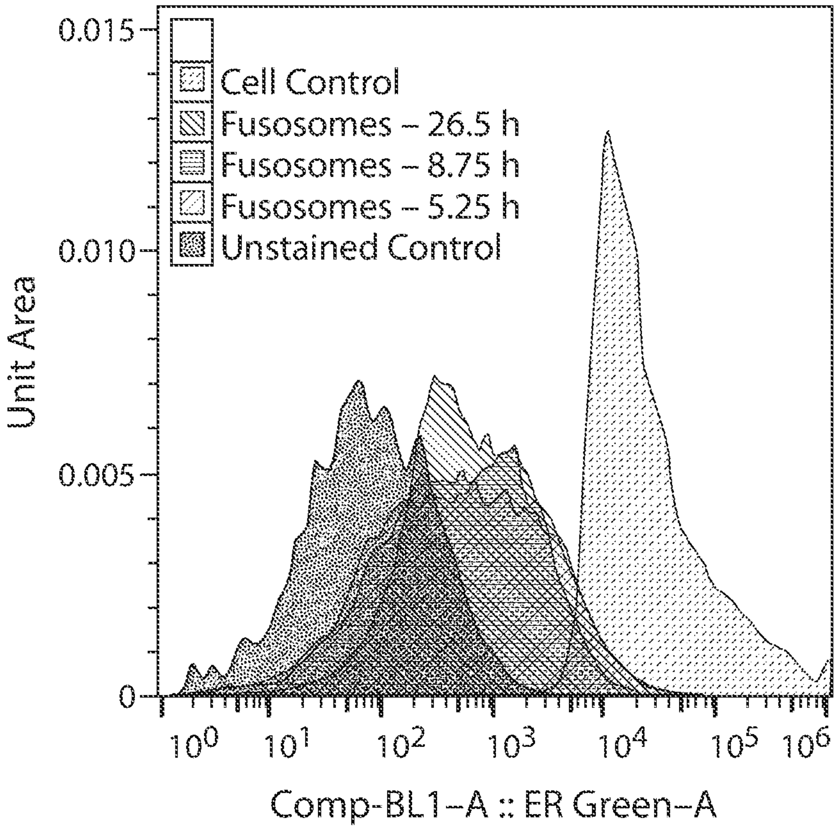
FIG. 1 quantifies staining of fusosomes with a dye for endoplasmic reticulum.

The invention describes fusosomes that include a membrane protein payload agent, and related methods.

Definitions

Agent: In general, the term "agent", as used herein, may be used to refer to a compound or entity including, for example, a peptide, a polypeptide, a nucleic acid (e.g., DNA, a chromosome (e.g. a human artificial chromosome), RNA, mRNA, siRNA, miRNA), a saccharide or a polysaccharide, a lipid, a small molecule, or a combination or complex thereof. The term may refer to an entity that is or comprises an organelle, or a fraction, extract, or component thereof.

Antibody: As used herein, the term "antibody" refers to a polypeptide that includes canonical immunoglobulin sequence elements sufficient to confer specific binding to a particular target antigen. For purposes of the present invention, in certain embodiments, any polypeptide or complex of polypeptides that includes sufficient immunoglobulin domain sequences to confer specific binding to an antigen can be referred to and/or used as an "antibody", whether such polypeptide is naturally produced (e.g., generated by an organism reacting to an antigen), or produced by recombinant engineering, chemical synthesis, or other artificial system or methodology. In some embodiments, an antibody is polyclonal; in some embodiments, an antibody is monoclonal. In some embodiments, an antibody has constant region sequences that are characteristic of mouse, rabbit, primate, or human antibodies. In some embodiments, antibody sequence elements are humanized, primatized, chimeric, etc. In embodiments, an antibody utilized in accordance with the present invention is in a format selected from, but not limited to, intact IgA, IgG, IgE or IgM antibodies; bi- or multi-specific antibodies (e.g., Zybodies®, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies (e.g., shark single domain antibodies such as IgNAR or fragments thereof); cameloid antibodies; masked antibodies (e.g., Probodies®)); Small Modular ImmunoPharmaceuticals ("SMIPs™"); single chain or Tandem diabodies (TandAb®); VHHs; Anticalins®); Nanobodies®; minibodies; BiTE®s; ankyrin repeat proteins or DARPINs®; Avimers C); DARTs; TCR-like antibodies; Adnectins®); Affilisn®); Trans-Bodies®); Affibodies®); TrimerX®); MicroProteins; Fynomers®, Centyrins®; and KALBITOR®s. In some embodiments, an antibody may lack a covalent modification (e.g., attachment of a glycan) that it would have if produced naturally. In some embodiments, an antibody may contain a covalent modification (e.g., attachment of a glycan, a payload [e.g., a detectable moiety, a therapeutic moiety, a catalytic moiety, etc.], or other pendant group [e.g., poly-ethylene glycol, etc.]. In some embodiments, an antibody of any of the above-described formats comprises one or more complement determining regions, e.g., CDR1, CD2, and/or CDR3.

Antigen binding domain: The term "antigen binding domain" as used herein refers to that portion of antibody or a chimeric antigen receptor which binds an antigen. In some embodiments, an antigen binding domain binds to a cell surface antigen of a cell. In some embodiments an antigen binding domain binds an antigen characteristic of a cancer, e.g., a tumor associated antigen in a neoplastic cell. In some embodiments, an antigen binding domain binds an antigen characteristic of an infectious disease, e.g. a virus associated antigen in a virus infected cell. In some embodiments, an antigen binding domain binds an antigen characteristic of a cell targeted by a subject's immune system in an autoimmune disease, e.g., a self-antigen. In some embodiments, an antigen binding domain is or comprises an antibody or antigen-binding portion thereof. In some embodiments, an antigen binding domain is or comprises an scFv or Fab.

Associated with: In some embodiments, two or more entities are physically "associated" with one another if they interact, directly or indirectly, so that they are and/or remain in physical proximity with one another. In some embodiments, two or more entities that are physically associated with one another are covalently linked to one another; in some embodiments, two or more entities that are physically associated with one another are not covalently linked to one another but are non-covalently associated, for example by means of hydrogen bonds, van der Waals interaction, hydrophobic interactions, magnetism, and combinations thereof.

Cancer: The terms "cancer", "malignancy", "neoplasm", "tumor", and "carcinoma", are used herein to refer to cells that exhibit relatively abnormal, uncontrolled, and/or autonomous growth, so that they exhibit an aberrant growth phenotype characterized by a significant loss of control of cell proliferation. In some embodiments, a tumor may be or comprise cells that are precancerous (e.g., benign), malignant, pre-metastatic, metastatic, and/or non-metastatic. The present disclosure specifically identifies certain cancers to which its teachings may be particularly relevant. In some embodiments, a relevant cancer may be characterized by a solid tumor. In some embodiments, a tumor may be a disperse tumor or a liquid tumor. In some embodiments, a relevant cancer may be characterized by a hematologic tumor. In general, examples of different types of cancers known in the art include, for example, leukemias, lymphomas (Hodgkin's and non-Hodgkin's), myelomas and myeloproliferative disorders; sarcomas, melanomas, adenomas, carcinomas of solid tissue, squamous cell carcinomas of the mouth, throat, larynx, and lung, liver cancer, genitourinary cancers such as prostate, cervical, bladder, uterine, and endometrial cancer and renal cell carcinomas, bone cancer, pancreatic cancer, skin cancer, cutaneous or intraocular melanoma, cancer of the endocrine system, cancer of the thyroid gland, cancer of the parathyroid gland, head and neck cancers, breast cancer, gastrointestinal cancers and nervous system cancers, benign lesions such as papillomas, and the like.

Cargo: As used herein, "cargo" or "payload" comprises an agent which may be delivered by a fusosome to a target cell. In some embodiments a cargo comprises one or more of a therapeutic agent, e.g., a therapeutic agent that is endogenous or exogenous to the source cell. In some embodiments, the therapeutic agent is chosen from one or more of a protein, e.g., an enzyme, a transmembrane protein, a receptor, an antibody; a nucleic acid, e.g., DNA, a chromosome (e.g. a human artificial chromosome), RNA, mRNA, siRNA, miRNA, or a small molecule. In some embodiments, a cargo is or comprises a membrane protein payload agent. In some embodiments, a cargo is or comprises an organelle.

CDR: As used herein, "CDR" refers to a complementarity determining region, e.g., which can be situated within an antibody variable region. There are three CDRs in each of the variable regions of the heavy chain and the light chain, which are designated CDR1, CDR2 and CDR3, for each of the variable regions. A "set of CDRs" or "CDR set" refers to a group of three or six CDRs that occur in either a single variable region capable of binding the antigen or the CDRs of cognate heavy and light chain variable regions capable of binding the antigen. Certain systems have been established in the art for defining CDR boundaries (e.g., Kabat, Chothia, etc.); those skilled in the art appreciate the differences between and among these systems and are capable of understanding CDR boundaries to the extent required to understand and to practice the claimed invention.

Cell Membrane: As used herein, a "cell membrane" refers to a membrane derived from a cell, e.g., a source cell or a target cell.

Cytobiologic: As used herein, "cytobiologic" refers to a portion of a cell that comprises a lumen and a cell membrane, or a cell having partial or complete nuclear inactivation. In some embodiments, the cytobiologic comprises one or more of a cytoskeleton component, an organelle, and a ribosome. In embodiments, the cytobiologic is an enucleated cell, a microvesicle, or a cell ghost.

Cytosol: As used herein, "cytosol" refers to the aqueous component of the cytoplasm of a cell. The cytosol may comprise proteins, RNA, metabolites, and ions.

Endogenous: As used herein, the term "endogenous" refers to an agent, e.g., a protein or lipid that is naturally found in a relevant system (e.g., cell, tissue, organism, source cell, or target cell, etc). For example, in some embodiments, a fusosome or a membrane-enclosed preparation may be said to contain one or more "endogenous" lipids and/or proteins when the relevant lipids and/or proteins are naturally found in a source cell from which the fusosome or membrane-enclosed preparation is obtained or derived (e.g., the source cell of the fusosome or membrane-enclosed preparation). In some embodiments, an endogenous agent is overexpressed in a source cell.

Exogenous: As used herein, the term "exogenous" refers to an agent (e.g., a protein or lipid) that is not naturally found in a relevant system (e.g., a cell, a tissue, an organism, a source cell or a target cell, etc.). In embodiments, the agent is engineered and/or introduced into the relevant system, For example, in some embodiments, a fusosome or a membrane-enclosed preparation may be said to contain one or more "exogenous" lipids and/or proteins when the relevant lipids and/or proteins are not naturally found in a source cell from which the fusosome or membrane-enclosed preparation is obtained or derived (e.g., the source cell of the fusosome or membrane-enclosed. In some embodiments, an exogenous agent is a variant of an endogenous agent, such as, for example, a protein variant that differs in one or more structural aspects such as amino acid sequence, post-translational modification, etc from a reference endogenous protein, etc).

Functional variant: The term "functional variant" refers to a polypeptide that has a substantially identical amino acid sequence to a reference amino acid sequence, or is encoded by a substantially identical nucleotide sequence, and is capable of having one or more activities of the reference amino acid sequence.

Fused Cell: As used herein, a "fused cell" refers to a cell produced by the contacting of one or more fusosomes with a target cell. In some embodiments of the fused cell, at least a portion of the lipid bilayer of one or more fusosomes is associated with a membrane of the target cell.

Fusogen: As used herein, "fusogen" refers to an agent or molecule that creates an interaction between two membrane enclosed lumens. In embodiments, the fusogen facilitates fusion of the membranes. In other embodiments, the fusogen creates a connection, e.g., a pore, between two lumens (e.g., the lumen of the fusosome and a cytoplasm of a target cell). In some embodiments, the fusogen comprises a complex of two or more proteins, e.g., wherein neither protein has fusogenic activity alone.

Fusogen binding partner: As used herein, "fusogen binding partner" refers to an agent or molecule that interacts with a fusogen to facilitate fusion between two membranes. In some embodiments, a fusogen binding partner may be or comprise a surface feature of a cell.

Fusosome Composition: As used herein, "fusosome composition" refers to a composition comprising one or more fusosomes.

Membrane protein payload agent: As used herein, "membrane protein payload agent" refers to a cargo that is or comprises a membrane protein and/or a nucleic acid encoding a membrane protein, which cargo may be included in a fusosome or membrane-enclosed preparation as described herein (e.g., for delivery to a target cell). A membrane protein is a protein which associates with (e.g., is localized in and/or on) or is capable of associating with a cell membrane. In some embodiments a membrane protein is a transmembrane protein. In some embodiments, a membrane protein comprises a domain that at least partially (e.g., completely) spans a membrane, e.g., cell membrane. In some embodiments, a membrane protein is associated with an interior (e.g., cytosolic) portion of a membrane lipid bilayer. In some embodiments a membrane protein is associated with an exterior portion of a membrane lipid bilayer (e.g., with a cell surface or with a surface of a fusosome or a membrane-enclosed preparation as described herein). In some embodiments, a membrane protein is associated with an exterior portion of a membrane lipid bilayer is a cell surface protein. In some embodiments a membrane protein passes through a membrane lipid bilayer and is secreted. In some embodiments a membrane protein is a naturally occurring protein. In some embodiments a membrane protein is an engineered and/or synthetic protein (e.g., a chimeric antigen receptor). In some embodiments a membrane protein is a therapeutic agent.

Nuclear payload agent: As used herein, "nuclear payload agent" refers to a cargo that is or comprises or encodes an agent that localizes to the nucleus, which cargo may be included in a fusosome or membrane-enclosed preparation as described herein (e.g., for delivery to a target cell). In some embodiments, a nuclear payload agent becomes preferentially enriched in the nucleoplasm, nucleolus, perionucleolar region, a Cajal body, a clastosome, a gems nuclear body, a histone locus body (HLB), a nuclear speckle, a nuclear stress body, a paraspeckle, a PML body, a polycomb body. In some embodiments a nuclear payload agent is a nuclear protein payload agent. In some embodiments, a nuclear payload agent comprises a functional nucleic acid and/or a non-coding nucleic acid.

Nuclear protein payload agent: As used herein, "nuclear protein payload agent" refers to a cargo that is or comprises a nuclear protein and/or a nucleic acid encoding a nuclear protein, which cargo may be included in a fusosome or membrane-enclosed preparation as described herein (e.g., for delivery to a target cell). A nuclear protein is a protein which associates with or is capable of associating with the nucleus. In some embodiments, a nuclear protein becomes preferentially enriched in the nucleoplasm, nucleolus, perionucleolar region, a Cajal body, a clastosome, a gems nuclear body, a histone locus body (HLB), a nuclear speckle, a nuclear stress body, a paraspeckle, a PML body, a polycomb body. In some embodiments a nuclear protein is a naturally occurring protein. In some embodiments a nuclear protein is an engineered and/or synthetic protein. In some embodiments a nuclear protein is a therapeutic agent.

Organellar payload agent: As used herein, "organellar payload agent" refers to a cargo that is or comprises or encodes an agent that localizes to a cytosolic organelle, which cargo may be included in a fusosome or membrane-enclosed preparation as described herein (e.g., for delivery to a target cell). The nucleus is not a cytosolic organelle. In some embodiments, the organelle is a membrane-bound organelle. On other embodiments, the organelle is not a membrane-bound organelle. In some embodiments, the cytosolic organelle is a mitochondrion, Golgi apparatus, endoplasmic reticulum, vacuole, acrosome, autophagosome, centriole, glycosome, glyoxysome, hydrogenosome, melanosome, mitosome, cnidocyst, peroxisome, proteasome, vesicle, stress granule, lysosome, or endosome. In some embodiments an organellar payload agent is an organellar protein payload agent. In some embodiments, an organellar payload agent comprises a functional nucleic acid and/or a non-coding nucleic acid.

Organellar protein payload agent: As used herein, "organellar protein payload agent" refers to a cargo that is or comprises an protein that becomes preferentially enriched in a cytosolic organelle, and/or a nucleic acid encoding said protein, which cargo may be included in a fusosome or membrane-enclosed preparation as described herein (e.g., for delivery to a target cell). In some embodiments the protein is an engineered and/or synthetic protein. In some embodiments the protein is a therapeutic agent.

Pharmaceutical composition: As used herein, the term "pharmaceutical composition" refers to an active agent, formulated together with one or more pharmaceutically acceptable carriers. In some embodiments, active agent is present in unit dose amount appropriate for administration in a therapeutic regimen to a relevant subject. In some embodiments, pharmaceutical compositions may be specially formulated for parenteral administration, for example, by subcutaneous, intramuscular, intravenous or epidural injection as, for example, a sterile solution or suspension, or sustained-release formulation.

Pharmaceutically acceptable carrier: As used herein, the term "pharmaceutically acceptable carrier" means a pharmaceutically-acceptable material, composition or vehicle, such as a liquid or solid filler, diluent, or excipient.

Preferentially enriched: As used herein, an agent that is "preferentially enriched" in a particular region of a target cell refers to the agent being present at a higher concentration in the particular region compared to at least one reference region of the cell. In some embodiments, the reference region is the cytosol. In some embodiments, an agent that is preferentially enriched in a particular region of the target cell is present at a higher concentration in the particular region compared to every other region of the cell. In some embodiments, the agent that is preferentially enriched in the particular region of the target cell is present at a concentration at least 10%, 20%, 30%, 40%, 50%, 60%, 70%, 80%, 90%, 2-fold, 5-fold, or 10-fold higher than the concentration in a reference region, e.g., the cysosol or plasma membrane. "Preferentially enriched" and "enriched" are used interchangeably herein.

Purified: As used herein, the term "purified" means altered or removed from the natural state. For example, a cell or cell fragment naturally present in a living animal is not "purified," but the same cell or cell fragment partially or completely separated from the coexisting materials of its natural state is "purified." A purified fusosome composition can exist in substantially pure form, or can exist in a non-native environment such as, for example, a culture medium such as a culture medium comprising cells.

Source cell: As used herein, a "source cell" refers to a cell from which a fusosome is derived, e.g., obtained. In some embodiments, derived includes obtaining a membrane enclosed preparation from a source cell and adding a fusogen.

Substantially identical: In the context of a nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity, for example, nucleotide sequences having at least about 85%, 90%, 91%, 92%, 93%, 94%, 95%, 96%, 97%, 98% or 99% identity to a reference sequence, e.g., a sequence provided herein. The compositions and methods herein encompass polypeptides and nucleic acids having the sequences specified, or sequences substantially identical or similar thereto, e.g., sequences at least 85%, 90%, or 95% identical or higher to the sequence specified. In the context of an amino acid sequence, the term "substantially identical" is used herein to refer to a first amino acid sequence that contains a sufficient or minimum number of amino acid residues that are i) identical to, or ii) conservative substitutions of aligned amino acid residues in a second amino acid sequence such that the first and second amino acid sequences can have a common structural domain and/or common functional activity, for example, amino acid sequences that contain a common structural domain having at least about 85%, 90%. 91%, 92%, 93%, 94%, 95%, 96%, 97%, 98% or 99% identity to a reference sequence, e.g., a sequence provided herein.

Target cell moiety: As used herein, the term "target cell moiety" is used to refer to a feature of a cell (e.g., a target cell) which may be used to specifically (relative to at least one other cell in the relevant system) target a fusosome to the cell. In some embodiments, a target cell moiety is a surface feature of a target cell. In some embodiments, a target cell moiety is or is a portion of a protein associated with the cell membrane of a target cell. In some embodiments, a target cell moiety is, or is a portion of, a peptide or protein associated with the membrane of a target cell. In some embodiments, a target cell moiety is or is a portion of a lipid associated with the membrane of a target cell. In some embodiments, a target cell moiety is or is a portion of a saccharide associated with the membrane of a target cell.

Targeting domain: As used herein, the term "targeting domain" is a feature of a fusosome which associates or interacts with a target cell moiety. In some embodiments, a targeting domain specifically (under conditions of exposure) associates or interacts with a target cell moiety. In some embodiments, a targeting domain specifically binds to a target cell moiety present on a target cell. In some embodiments, a targeting domain is or comprises a domain of a fusogen e.g., is covalently linked to a fusogen, e.g., is part of a fusogen polypeptide. In some embodiments, a targeting domain is a separate entity from any fusogen, e.g., is not covalently linked to a fusogen, e.g., is not part of a fusogen polypeptide.

Stable: The term "stable," when applied to compositions herein, means that the compositions maintain one or more aspects of their physical structure and/or activity over a period of time under a designated set of conditions. In some embodiments, the designated conditions are under cold storage (e.g., at or below about 4° C., −20° C., or −80° C.).

Target cell: As used herein "target cell" refers to a cell which a fusosome fuses to.

Variant: The term "variant" refers to a polypeptide that has a substantially identical amino acid sequence to a reference amino acid sequence, or is encoded by a substantially identical nucleotide sequence. In some embodiments, the variant is a functional variant.

Fusosomes

The fusosome compositions and methods described herein comprise (a) a lipid bilayer, (b) a lumen (e.g., comprising cytosol) surrounded by the lipid bilayer; (c) a fusogen that is exogenous or overexpressed relative to the source cell, e.g., wherein the fusogen is disposed in the lipid bilayer, and (d) a membrane protein payload agent. In embodiments, the fusosome is derived from a non-plant cell, e.g., a mammalian cell, or derivative thereof (e.g., a mitochondrion, a chondrisome, an organelle, a vesicle, or an enucleated cell), and comprises a fusogen, e.g., protein, lipid or chemical fusogen.

Encapsulation

In some embodiments of the compositions and methods described herein include fusosomes, e.g., naturally derived bilayers of amphipathic lipids with a fusogen. Fusosomes may comprise several different types of lipids, e.g., amphipathic lipids, such as phospholipids. Fusosomes may comprise a lipid bilayer as the outermost surface. Such compositions can surprisingly be used in the methods of the invention. In some instances, membranes may take the form of an autologous, allogeneic, xenogeneic or engineered cell such as is described in Ahmad et al. 2014 Mirol regulates intercellular mitochondrial transport & enhances mesenchymal stem cell rescue efficacy. EMBO Journal. 33(9):994-1010. In some embodiments, the compositions include engineered membranes such as described in, e.g. in Orive. et al. 2015. Cell encapsulation: technical and clinical advances. Trends in Pharmacology Sciences; 36 (8):537-46; and in Mishra. 2016. Handbook of Encapsulation and Controlled Release. CRC Press. In some embodiments, the compositions include naturally occurring membranes (McBride et al. 2012. A Vesicular Transport Pathway Shuttles Cargo from mitochondria to lysosomes. Current Biology 22:135-141).

In some embodiments, a composition described herein includes a naturally derived membrane, e.g., membrane vesicles prepared from cells or tissues. In some embodiments, a fusosome is a vesicle derived from MSCs or astrocytes.

In some embodiments, a fusosome is an exosome.

Exemplary exosomes and other membrane-enclosed bodies are described, e.g., in US2016137716, which is herein incorporated by reference in its entirety. In some embodiments, the fusosome comprises a vesicle that is, for instance, obtainable from a cell, for instance a microvesicle, an exosome, an apoptotic body (from apoptotic cells), a microparticle (which may be derived from e.g. platelets), an ectosome (derivable from, e.g., neutrophils and monocytes in serum), a prostatosome (obtainable from prostate cancer cells), a cardiosome (derivable from cardiac cells), and the like.

Exemplary exosomes and other membrane-enclosed bodies are also described in WO/2017/161010, WO/2016/077639, US20160168572, US20150290343, and US20070298118, each of which is incorporated by reference herein in its entirety. In some embodiments, the fusosome comprises an extracellular vesicle, nanovesicle, or exosome. In some embodiments a fusosome comprises an extracellular vesicle, e.g., a cell-derived vesicle comprising a membrane that encloses an internal space and has a smaller diameter than the cell from which it is derived. In embodiments the extracellular vesicle has a diameter from 20 nm to 1000 nm. In embodiments the fusosome comprises an apoptotic body, a fragment of a cell, a vesicle derived from a cell by direct or indirect manipulation, a vesiculated organelle, and a vesicle produced by a living cell (e.g., by direct plasma membrane budding or fusion of the late endosome with the plasma membrane). In embodiments the extracellular vesicle is derived from a living or dead organism, explanted tissues or organs, or cultured cells. In embodiments, the fusosome comprises a nanovesicle, e.g., a cell-derived small (e.g., between 20-250 nm in diameter, or 30-150 nm in diameter) vesicle comprising a membrane that encloses an internal space, and which is generated from said cell by direct or indirect manipulation. The production of nanovesicles can, in some instances, result in the destruction of the source cell. The nanovesicle may comprise a lipid or fatty acid and polypeptide. In embodiments, the fusosome comprises an exosome. In embodiments, the exosome is a cell-derived small (e.g., between 20-300 nm in diameter, or 40-200 nm in diameter) vesicle comprising a membrane that encloses an internal space, and which is generated from said cell by direct plasma membrane budding or by fusion of the late endosome with the plasma membrane. In embodiments, production of exosomes does not result in the destruction of the source cell. In embodiments, the exosome comprises lipid or fatty acid and polypeptide.

Exemplary exosomes and other membrane-enclosed bodies are also described in US 20160354313, which is herein incorporated by reference in its entirety. In embodiments, the fusosome comprises a Biocompatible Delivery Module, an exosome (e.g., about 30 nm to about 200 nm in diameter), a microvesicle (e.g., about 100 nm to about 2000 nm in diameter) an apoptotic body (e.g., about 300 nm to about 2000 nm in diameter), a membrane particle, a membrane vesicle, an exosome-like vesicle, an ectosome-like vesicle, an ectosome, or an exovesicle.

In some embodiments, a fusosome is a microvesicle. In some embodiments, a fusosome is a cell ghost. In some embodiments, a vesicle is a plasma membrane vesicle, e.g. a giant plasma membrane vesicle.

Fusosomes can be made from several different types of lipids, e.g., amphipathic lipids, such as phospholipids. The fusosome may comprise a lipid bilayer as the outermost surface. This bilayer may be comprised of one or more lipids of the same or different type. Examples include without limitation phospholipids such as phosphocholines and phosphoinositols. Specific examples include without limitation DMPC, DOPC, and DSPC.

Fusogens

In some embodiments, the fusosome described herein (e.g., comprising a vesicle or a portion of a cell) includes one or more fusogens, e.g., to facilitate the fusion of the fusosome to a membrane, e.g., a cell membrane. Also these compositions may include surface modifications made during or after synthesis to include one or more fusogens. The surface modification may comprise a modification to the membrane, e.g., insertion of a lipid or protein into the membrane.

In some embodiments, the fusosomes comprise one or more fusogens on their exterior surface (e.g., integrated into the cell membrane) to target a specific cell or tissue type (e.g., cardiomyocytes). Fusosomes may comprise a targeting domain. Fusogens include without limitation protein based, lipid based, and chemical based fusogens. The fusogen may bind a partner, e.g., a feature on a target cells' surface. In some embodiments the partner on a target cells' surface is a target cell moiety. In some embodiments, the fusosome comprising the fusogen will integrate the membrane into a lipid bilayer of a target cell.

In some embodiments, one or more of the fusogens described herein may be included in the fusosome.

Protein Fusogens

In some embodiments, the fusogen is a protein fusogen, e.g., a mammalian protein or a homologue of a mammalian protein (e.g., having 50%, 60%, 70%, 80%, 85%, 90%, 95%, 96%, 97%, 98%, 99%, or greater identity), a non-mammalian protein such as a viral protein or a homologue of a viral protein (e.g., having 50%, 60%, 70%, 80%, 85%, 90%, 95%, 96%, 97%, 98%, 99%, or greater identity), a native protein or a derivative of a native protein, a synthetic protein, a fragment thereof, a variant thereof, a protein fusion comprising one or more of the fusogens or fragments, and any combination thereof.

In some embodiments, the fusogen results in mixing between lipids in the fusosome and lipids in the target cell. In some embodiments, the fusogen results in formation of one or more pores between the lumen of the fusosome and the cytosol of the target cell, e.g., the fusosome is, or comprises, a connexin as described herein.

(i) Mammalian Proteins

In some embodiments, the fusogen may include a mammalian protein, see Table 1. Examples of mammalian fusogens may include, but are not limited to, a SNARE family protein such as vSNAREs and tSNAREs, a syncytin protein such as Syncytin-1 (DOI: 10.1128/JVI.76.13.6442-6452.2002), and Syncytin-2, myomaker (biorxiv.org/content/early/2017/04/02/123158, doi.org/10.1101/123158, doi: 10.1096/fj.201600945R, doi:10.1038/nature12343), myomixer (www.nature.com/nature/journal/v499/n7458/full/nature12343.html, doi:10.1038/nature12343), myomerger (science.sciencemag.org/content/early/2017/04/05/science.aam9361, DOI: 10.1126/science.aam9361), FGFRL1 (fibroblast growth factor receptor-like 1), Minion (doi.org/10.1101/122697), an isoform of glyceraldehyde-3-phosphate dehydrogenase (GAPDH) (e.g., as disclosed in U.S. Pat. No. 6,099,857A), a gap junction protein such as connexin 43, connexin 40, connexin 45, connexin 32 or connexin 37 (e.g., as disclosed in US 2007/0224176, Hap2, any protein capable of inducing syncytium formation between heterologous cells (see Table 2), any protein with fusogen properties (see Table 3), a homologue thereof, a fragment thereof, a variant thereof, and a protein fusion comprising one or more proteins or fragments thereof. In some embodiments, the fusogen is encoded by a human endogenous retroviral element (hERV) found in the human genome. Additional exemplary fusogens are disclosed in U.S. Pat. No. 6,099,857A and US 2007/0224176, the entire contents of which are hereby incorporated by reference.

TABLE 1

Non-limiting examples of human and non-human fusogens. Human and Non-Human Fusogen Classes

| Fusogen Class | Uniprot Protein Family ID | # of sequences |
| --- | --- | --- |
| EFF-AFF | PF14884 | 191 |
| SNARE | PF05739 | 5977 |
| DC-STAMP | PF07782 | 633 |
| ENV | PF00429 | 312 |

TABLE 2

Genes that encode proteins with fusogen properties. Human genes with the gene ontology annotation of: Syncytium formation by plasma membrane fusion proteins

| ID | Symbol |
| --- | --- |
| A0A024R0I0 | DYRK1B |
| A0A024R1N1 | MYH9 |
| A0A024R2D8 | CAV3 |
| A0A096LNV2 | FER1L5 |
| A0A096LPA8 | FER1L5 |
| A0A096LPB1 | FER1L5 |
| A0AVI2 | FER1L5 |
| A6NI61 | TMEM8C (myomaker) |
| B3KSL7 | — |
| B7ZLI3 | FER1L5 |
| H0YD14 | MYOF |
| O43184 | ADAM12 |
| O60242 | ADGRB3 |
| O60500 | NPHS1 |
| O95180 | CACNA1H |
| O95259 | KCNH1 |
| P04628 | WNT1 |
| P15172 | MYOD1 |
| P17655 | CAPN2 |
| P29475 | NOS1 |
| P35579 | MYH9 |
| P56539 | CAV3 |
| Q2NNQ7 | FER1L5 |
| Q4KMG0 | CDON |
| Q53GL0 | PLEKHO1 |
| Q5TCZ1 | SH3PXD2A |
| Q6YHK3 | CD109 |
| Q86V25 | VASH2 |
| Q99697 | PITX2 |
| Q9C0D5 | TANC1 |
| Q9H295 | DCSTAMP |
| Q9NZM1 | MYOF |
| Q9Y463 | DYRK1B |

TABLE 3

Human Fusogen Candidates

| Fusogen Class | Gene ID |
| --- | --- |
| SNARE | O15400 |
| | Q16623 |
| | K7EQB1 |
| | Q86Y82 |
| | E9PN33 |
| | Q96NA8 |
| | H3BT82 |
| | Q9UNK0 |
| | P32856 |
| | Q13190 |
| | O14662 |
| | P61266 |
| | O43752 |
| | O60499 |
| | Q13277 |
| | B7ZBM8 |

TABLE 3-continued

Human Fusogen Candidates

| Fusogen Class | Gene ID |
| --- | --- |
| | A0AVG3 |
| | Q12846 |
| DC-STAMP | Q9H295 |
| | Q5T1A1 |
| | Q5T197 |
| | E9PJX3 |
| | Q9BR26 |
| ENV | Q9UQF0 |
| | Q9N2K0 |
| | P60507 |
| | P60608 |
| | B6SEH9 |
| | P60508 |
| | B6SEH8 |
| | P61550 |
| | P60509 |
| | Q9N2J8 |
| Muscle Fusion (Myomaker) | H0Y5B2 |
| | H7C1S0 |
| | Q9HCN3 |
| | A6NDV4 |
| | K4DI83 |
| Muscle Fusion (Myomixer) | NP_001302423.1 |
| | ACT64390.1 |
| | XP_018884517.1 |
| | XP_017826615.1 |
| | XP_020012665.1 |
| | XP_017402927.1 |
| | XP_019498363.1 |
| | ELW65617.1 |
| | ERE90100.1 |
| | XP_017813001.1 |
| | XP_017733785.1 |
| | XP_017531750.1 |
| | XP_020142594.1 |
| | XP_019649987.1 |
| | XP_019805280.1 |
| | NP_001170939.1 |
| | NP_001170941.1 |
| | XP_019590171.1 |
| | XP_019062106.1 |
| | EPQ04443.1 |
| | EPY76709.1 |
| | XP_017652630.1 |
| | XP_017459263.1 |
| | OBS58441.1 |
| | XP_017459262.1 |
| | XP_017894180.1 |
| | XP_020746447.1 |
| | ELK00259.1 |
| | XP_019312826.1 |
| | XP_017200354.1 |
| | BAH40091.1 |
| HA | P03452 |
| | Q9Q0U6 |
| | P03460 |
| GAP JUNCTION | P36382 |
| | P17302 |
| | P36383 |
| | P08034 |
| | P35212 |
| Other | FGFRL1 |
| | GAPDH |

In some embodiments, the fusosome comprises a curvature-generating protein, e.g., Epsin1, dynamin, or a protein comprising a BAR domain. See, e.g., Kozlov et al, CurrOp StrucBio 2015, Zimmerberg et al. Nat Rev 2006, Richard et al, Biochem J 2011.

(ii) Non-Mammalian Proteins

Viral Proteins

In some embodiments, the fusogen may include a non-mammalian protein, e.g., a viral protein. In some embodiments, a viral fusogen is a Class I viral membrane fusion protein, a Class III viral membrane fusion protein, a viral membrane glycoprotein, or other viral fusion proteins, or a homologue thereof, a fragment thereof, a variant thereof, or a protein fusion comprising one or more proteins or fragments thereof.

In some embodiments, Class I viral membrane fusion proteins include, but are not limited to, Baculovirus F protein, e.g., F proteins of the nucleopolyhedrovirus (NPV) genera, e.g., *Spodoptera exigua* MNPV (SeMNPV) F protein and *Lymantria dispar* MNPV (LdMNPV).

In some embodiments, Class III viral membrane fusion proteins include, but are not limited to, rhabdovirus G (e.g., fusogenic protein G of the Vesicular Stomatatis Virus (VSV-G)), herpesvirus glycoprotein B (e.g., Herpes Simplex virus 1 (HSV-1) gB)), Epstein Barr Virus glycoprotein B (EBV gB), thogotovirus G, baculovirus gp64 (e.g., *Autographa* California multiple NPV (AcMNPV) gp64), and Borna disease virus (BDV) glycoprotein (BDV G).

Examples of other viral fusogens, e.g., membrane glycoproteins and viral fusion proteins, include, but are not limited to: viral syncytia proteins such as influenza hemagglutinin (HA) or mutants, or fusion proteins thereof; human immunodeficiency virus type 1 envelope protein (HIV-1 ENV), gp120 from HIV binding LFA-1 to form lymphocyte syncytium, HIV gp41, HIV gp160, or HIV Trans-Activator of Transcription (TAT); viral glycoprotein VSV-G, viral glycoprotein from vesicular stomatitis virus of the Rhabdoviridae family; glycoproteins gB and gH-gL of the varicella-zoster virus (VZV); murine leukaemia virus (MLV)-10A1; Gibbon Ape Leukemia Virus glycoprotein (GaLV); type G glycoproteins in Rabies, Mokola, vesicular stomatitis virus and Togaviruses; murine hepatitis virus JHM surface projection protein; porcine respiratory coronavirus spike- and membrane glycoproteins; avian infectious bronchitis spike glycoprotein and its precursor; bovine enteric coronavirus spike protein; the F and H, HN or G genes of Measles virus; canine distemper virus, Newcastle disease virus, human parainfluenza virus 3, simian virus 41, Sendai virus and human respiratory syncytial virus; gH of human herpesvirus 1 and simian varicella virus, with the chaperone protein gL; human, bovine and cercopithicine herpesvirus gB; envelope glycoproteins of Friend murine leukaemia virus and Mason Pfizer monkey virus; mumps virus hemagglutinin neuraminidase, and glyoproteins F1 and F2; membrane glycoproteins from Venezuelan equine encephalomyelitis; paramyxovirus F protein; SIV gp160 protein; Ebola virus G protein; or Sendai virus fusion protein, or a homologue thereof, a fragment thereof, a variant thereof, and a protein fusion comprising one or more proteins or fragments thereof.

Non-mammalian fusogens include viral fusogens, homologues thereof, fragments thereof, and fusion proteins comprising one or more proteins or fragments thereof. Viral fusogens include class I fusogens, class II fusogens, class III fusogens, and class IV fusogens. In embodiments, class I fusogens such as human immunodeficiency virus (HIV) gp41, have a characteristic postfusion conformation with a signature trimer of α-helical hairpins with a central coiled-coil structure. Class I viral fusion proteins include proteins having a central postfusion six-helix bundle. Class I viral fusion proteins include influenza HA, parainfluenza F, HIV Env, Ebola GP, hemagglutinins from orthomyxoviruses, F proteins from paramyxoviruses (e.g. Measles, (Katoh et al. BMC Biotechnology 2010, 10:37)), ENV proteins from retroviruses, and fusogens of filoviruses and coronaviruses. In embodiments, class II viral fusogens such as dengue E glycoprotein, have a structural signature of β-sheets forming an elongated ectodomain that refolds to result in a trimer of hairpins. In embodiments, the class II viral fusogen lacks the central coiled coil. Class II viral fusogen can be found in alphaviruses (e.g., E1 protein) and flaviviruses (e.g., E glycoproteins). Class II viral fusogens include fusogens from Semliki Forest virus, Sinbis, rubella virus, and dengue virus. In embodiments, class III viral fusogens such as the vesicular stomatitis virus G glycoprotein, combine structural signatures found in classes I and II. In embodiments, a class III viral fusogen comprises a helices (e.g., forming a six-helix bundle to fold back the protein as with class I viral fusogens), and β sheets with an amphiphilic fusion peptide at its end, reminiscent of class II viral fusogens. Class III viral fusogens can be found in rhabdoviruses and herpesviruses. In embodiments, class IV viral fusogens are fusion-associated small transmembrane (FAST) proteins (doi: 10.1038/sj.emboj.7600767, Nesbitt, Rae L., "Targeted Intracellular Therapeutic Delivery Using Liposomes Formulated with Multifunctional FAST proteins" (2012). Electronic Thesis and Dissertation Repository. Paper 388), which are encoded by nonenveloped reoviruses. In embodiments, the class IV viral fusogens are sufficiently small that they do not form hairpins (doi: 10.1146/annurev-cellbio-101512-122422, doi:10.1016/j.devcel.2007.12.008).

Additional exemplary fusogens are disclosed in U.S. Pat. No. 9,695,446, US 2004/0028687, U.S. Pat. Nos. 6,416,997, 7,329,807, US 2017/0112773, US 2009/0202622, WO 2006/027202, and US 2004/0009604, the entire contents of all of which are hereby incorporated by reference.

In some embodiments, a fusogen described herein comprises an amino acid sequence of Table 4, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to any amino acid sequence of Table 4. In some embodiments, a nucleic acid sequence described herein encodes an amino acid sequence of Table 4, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

In some embodiments, a fusogen described herein comprises an amino acid sequence set forth in any one of SEQ ID NOS: 627-683, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to an amino acid sequence set forth in any one of SEQ ID NOS: 627-683. In some embodiments, a nucleic acid sequence described herein encodes an amino acid sequence set forth in any one of SEQ ID NOS: 627-683, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

TABLE 4

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| KP317927 | 5630-7399 | gb:KP317927:5630-7399\|Organism:Human respiratory syncytial virus\|Strain Name:Kilifi_9465_7_RSVB_2011\|Protein Name:fusion glycoprotein\|Gene Symbol:F | MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK | 993 | 627 |
| AB524405 | 4556-6217 | gb:AB524405:4556-6217\|Organism:New castle disease virus\|Strain Name:Goose/Alaska/415/91\|Protein Name:fusion protein\|Gene Symbol:F | MDPKPSTSYLHAFPLIFVAISLVFMAGRASALDGRPLAAAGIVVTGDKAVNIYTSSQTGTIIIKLLPNMPKDKEQCAKSPLDAYNRTLTTLLAPLGDSIRRIQESVTTSGGERQERLVGAIIGGVALGVATAAQITAASALIQANQNAANILKLKESIAATNEAVHEVTSGLSQLAVAVGKMQQFVNDQFNKTAQEIDCIKITQQVGVELNLYLTELTTVFGPQITSPALTQLTIQALYNLAGGNMDYMLTKLGVGNNQLSSLISSGLISGNPILYDSQTQLLGIQVTLPSVGNLNNMRATYLETLSVSTNKGFASALVPKVVTQVGSVIEELDTSYCIETDLDLYCTRIVTFPMSPGIFSCLGGNTSACMYSKTEGALTTPYMTLKGSVIANCKMTTCRCADPPGIISQNYGEAVSLIDKKVCNILTLDGITLRLSGEFDATYQKNISIQDSQVVITGNLDISTELGNVNNSISNALDKLEESNSKLDKVNVRLTSTSALITYIVLTTIALICGIVSLVLACYIMYKQKAQQKTLLWLGNNTLDQMRATTKM | 418 | 628 |
| AF266286 | 4875-7247 | gb:AF266286:4875-7247\|Organism:Measles virus strain AIK-C\|Strain Name:Measles virus strain Edmonston (AIK-C vaccine)\|Protein Name:fusion protein\|Gene Symbol:F | MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGYTKSCARTLVSGSFGNRFILSQGNLIANCASILCKCYTTGTIINQDPDKILTYIAADNCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL | 128 | 629 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| AB503857 | 3068-4687 | gb:AB503857:3068-4687\|Organism:Human metapneumovirus\|Strain Name:Jpn 03-1\|Protein Name:fusion glycoprotein precursor\|Gene Symbol:F | MSWKVVIIFSLLITPQHGLKESYLEESCSTITEGYLSVLRTGWYTNVFTLEVGDVENLTCSDGPSLIKTELDLTKSALRELKTVSADQLAREEQIEKPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS | 125 | 630 |
| EU277658 | 5078-6700 | gb:EU277658:5078-6700\|Organism:Bovine parainfluenza virus 3\|Strain Name:Q5592\|Protein Name:fusion protein\|Gene Symbol:F | MIIIVITMILSLTPSSLCQIDITKLQSVGVLVNSPKGIKISQNFETRYLILSLIPKIEDSHSCGNQQIDQYKKLLDRLIIPLYDGLKLQKDVIVVNHESHNNTNLRTKRFFGEIIGTIAIGIATSAQITAAVALVEAKQARSDIDKLKEAIKDTNKAVQSIQSSVGNLIVAVKSVQDYVNNEIVPSITRLGCEAAGLQLGIALTQHYSELTNIFGDNIGTLGEKGVKLQGIASLYRTNITEVFTTSTVDQYDIYDLLFTESIKMRVIDVDLSDYSITLQVRLPLLTKVSNTQIYKVDSISYNIQGKEWYIPLPHHIMTKGAFLGGADIKECIESFSNYICPSDPGFILNHEMENCLSGNITQCPKTIVTSDIVPRYAFVDGGVIANCIPTTCTCNGIDNRINQSPDQGIKIITYKECQIVGINGMLFKTNQEGTLAKYTFDNIKLNNSVALNPIDISLELNKAKSDLEESKRWIEKSNQKLDSIGSWHQSSVTIIIIIVMIVVLLIINAIIIMIMIRYLRDRNRHLNNKDSEPYVLTNRQ | 93 | 631 |
| AB040874 | 4546-6162 | gb:AB040874:4546-6162\|Organism:Mumps virus\|Strain Name:Miyahara\|Protein Name:fusion protein\|Gene Symbol:F | MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY | 89 | 632 |
| AB475097 | 4908-6923 | gb:AB475097:4908-6923\|Organism:Canine distemper | MNPHEQTIPMHEKIPKRSKTQTHTQQDLPQQHSTKSAESKTSRARHSITSAQRSTHYDPRTADWPDYYIMKRTRSCKQ | 46 | 633 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | virus\|Strain Name:M25CR\| Protein Name:fusion protein\|Gene Symbol:F | ASYRSDNIPAHGDHDGIIHHTPESVSQ GAKSRLKMGQSNAVKSGSQCTWLVL WCIGVASLFLCSKAQIHWNNLSTIGII GTDSVHYKIMTRPSHQYLVIKLMPNV SLIDNCTKAELDEYEKLLSSILEPINQA LTLMTKNVKPLQSVGSGRRQRRFAG VVLAGAALGVATAAQITAGIALHQSN LNAQAIQSLRTSLEQSNKAIEEIREATQ ETVIAVQGVQDYVNNELVPAMQHMS CELVGQRLGLKLLRYYTELLSIFGPSL RDPISAEISIQALSYALGGEIHKILEKL GYSGNDMIAILESRGIKTKITHVDLPG KFIILSVSYPTLSEVKGVIVHRLEAVSY NIGSQEWYTTVPRYVATNGYLISNFD ESSCVFVSESAICSQNSLYPMSPLLQQ CIRGDTSSCARTLVSGTMGNKFILSKG NIVANCASILCKCYSTSTIINQSPDKLL TFIASDTCPLVEIDGVTIQVGSRQYPD MVYESKVALGPAISLERLDVGTNLGN ALKKLDDAKVLIDSSNQILETVRRSSF NFGSLLSVPILSCTALALLLLICCCKRR YQQTHKQNTKVDPTFKPDLTGTSRSY VRSL | | |
| AJ849636 | 5526-7166 | gb:AJ849636:5526-7166\| Organism:Peste-des-petits-ruminants virus\|Strain Name:Turkey 2000\|Protein Name:fusion protein\|Gene Symbol:F | MTRVAILTFLFLFPNAVACQIHWGNL SKIGIVGTGSASYKVMTRPSHQTLVIK LMPNITAIDNCTKSEIAEYKRLLITVLK PVEDALSVITKNVRPIQTLTPGRRTRR FAGAVLAGVALGVATAAQITAGVAL HQSLMNSQAIESLKTSLEKSNQAIEEIR LANKETILAVQGVQDYINNELVPSVH RMSCELVGHKLGLKLLRYYTEILSIFG PSLRDPIAAEISIQALSYALGGDINRIL DKLGYSGGDFLAILESKGIKARVTYV DTRDYFIILSIAYPTLSEIKGVIVHKIEA ITYNIGAQEWYTTIPKYVATQGYLISN FDETSCVFTPDGTVCSQNALYPMSPLL QECFQGSTKSCARTLVSGTISNRFILSK GNLIANCASVLCKCYTTETVISQDPDK LLTVVASDKCPVVEVDGVTIQVGSRE YPDSVYLHKIDLGPAISLEKLDVGTNL GNAVTRLENAKELLDASDQILKTVKG VPFGGNMYIALAACIGVSLGLVTLICC CKGRCKNKEVPISKINPGLKPDLTGTS KSYVRSL | 34 | 634 |
| AF017149 | 6618-8258 | gb:AF017149\| Organism:Hendra virus\|Strain Name:UNKNOWN-AF017149\| Protein Name:fusion\| Gene Symbol:F | MATQEVRLKCLLCGIIVLVLSLEGLGI LHYEKLSKIGLVKGITRKYKIKSNPLT KDIVIKMIPNVSNVSKCTGTVMENYK SRLTGILSPIKGAIELYNNNTHDLVGD VKLAGVVMAGIAIGIATAAQITAGVA LYEAMKNADNINKLKSSIESTNEAVV KLQETAEKTVYVLTALQDYINTNLVP TIDQISCKQTELALDLALSKYLSDLLF VFGPNLQDPVSNSMTIQAISQAFGGN YETLLRTLGYATEDFDDLLESDSIAGQ IVYVDLSSYYIIVRVYFPILTEIQQAYV QELLPVSFNNDNSEWISIVPNFVLIRNT LISNIEVKYCLITKKSVICNQDYATPM TASVRECLTGSTDKCPRELVVSSHVPR FALSGGVLFANCISVTCQCQTTGRAIS QSGEQTLLMIDNTTCTTVVLGNIIISLG KYLGSINYNSESIAVGPPVYTDKVDIS SQISSMNQSLQQSKDYIKEAQKILDTV NPSLISMLSMIILYVLSIAALCIGLITFIS FVIVEKKRGNYSRLDDRQVRPVSNGD LYYIGT | 29 | 635 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| AB005795 | 4866-6563 | gb:AB005795:4866-6563\|Organism:Sendai virus\|Strain Name:Ohita\|Protein Name:fusion protein\|Gene Symbol:F | MATYIQRVQCISALLSVVLTTLVSCQIPRDRLSNIGVIVDEGKSLKIAGSHESRYIVLSLVPGIDLENGCGTAQVIQYKSLLNRLLIPLRDALDLQEALITVTNDTMTGADVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDNIIPKFAFVNGGVVANCIASTCTCGTGRRPISQDRSKGVVFLTHDNCGLIGVNGIELYANRKGHDATWGVQNLTVGPAIAIRPVDISLNLAAATDFLQDSRAELEKARKILSEVGRWYNSGATLITIIVVMIVVLVVIIVIVIVLYRLRRSMLMSNPAGRISRDTYTLEPKIRHMYTNGGFDAMTEKR | 23 | 636 |
| AF457102 | 5088-6755 | gb:AF457102\|Organism:Human parainfluenza virus 1 strain Washington/1964\|Strain Name:Washington 1964\|Protein Name:F glycoprotein\|Gene Symbol:F | MQKSEILFLVYSSLLLSSSLCQIPVEKLSNVGVIINEGKLLKIAGSYESRYIVLSLVPSIDLQDGCGTTQIIQYKNLLNRLLIPLKDALDLQESLITITNDTTVTNDNPQTRFFGAVIGTIALGVATAAQITAGIALAEAREARKDIALIKDSIVKTHNSVELIQRGIGEQIIALKTLQDFVNDEIRPAIGELRCETTALKLGIKLTQHYSELATAFSSNLGTIGEKSLTLQALSSLYSANITEILSTTKKDKSDIYDIIYTEQVKGTVIDVDLEKYMVTLLVKIPILSEIPGVLIYRASSISYNIEGEEWHVAIPNYIINKASSLGGADVTNCIESKLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKTELMKARAIISAVGGWHNTESTQIIMIIIVCILIIIICGILYYLYRVRRLLVMINSTHNSPVNAYTLESRMRNPYMGNNSN | 21 | 637 |
| AB910309 | 4951-6582 | gb:AB910309:4951-6582\|Organism:Feline morbillivirus\|Strain Name:SS1\|Protein Name:fusion protein\|Gene Symbol:F | MGKIRVIIISSLLLSNITTAQVGWDNLTSIGVISTKQYDYKITTLNTNQLMVIKMVPNISSIINCTKPELMKYRELVLGVIRPINESLELMNSYINMRAGSERFIGAVIAGVALGVATAAQITSGIALHNSIMNKRQIQELRKALSTTNKAIDEIRIAGERTLIAVQGVQDYINNIIIPMQDKLQCDILSSQLAIALLRYYTNILTVFGPSIRDPVTSIISIQALSQAFNGNLQALLDGLGYTGRDLRDLLESRSITGQIIHADMTDLFLVLRINYPSITEMQGVTIYELNSITYHIGPEEWYTIMPNFIAVQGFLTSNFDERKCSITKSSILCQQNSIYPMSTEMQRCIKGEIRFCPRSKAVGTLVNRFILTKGNLMANCLGVICRCYSSGQIITQDPSKLITIISQEECKEVGVDGIRIMVGPRKLPDVIFNARLEVGVPISLSKLDVGTDLAIASAKLNNSKALLEQSDKILDSMSKLDSINSRITGLILAIMAIFIITVTIIWIIYKRCRNKDNKFSTSIEPLYIPPSYNSPHSVVKSI | 12 | 638 |
| KT071755 | 4310-6070 | gb:KT071755:4310-6070\|Organism:Avian paramyxovirus | MIAALFISLFATCGALDNSVLAPVGIASAQEWQLAAYTNTLSGTIAVRFVPVLPGNLSTCAQATLAEYNKTVTNILGPL | 12 | 639 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | 2\|Strain Name:APMV-2/Procarduelis nipalensis/China/Suiling/53/2013\|Protein Name:fusion protein\|Gene Symbol:F | KENLETLLSEPTKTAARFVGAIIGTVALGVATSAQITAAVALNQAQENARNIWRLKESIRKTNEAVLELKDGLASTAIALDKVQKFINEDIIPQIKEIDCQVVANKLGVYLSLYLTELTTIFGAQITNPALTPLSYQALYNLCGGDMGKLTELIGVKAKDINSLYEANLITGQVIGYDSESQIILIQVSYPSVSEVTGVRATELVTVSVTTPKGEGRAIAPKYVAQSRVVTEELDTSTCRFSKTTLYCRSIITRPLPPLIANCLNGLYQDCQYTTEIGALSSRFITVNGGIIANCRATICKCVNPPKIIVQSDASSLTVIDSAICKDVVLDNVQLRLEGKLSAQYFTNITIDLSQITTSGSLDISSEIGSINNTVNKVEELIAESNAWLQAVNPHLVNNTSIIVLCVLAAIFVVWLVALTGCLAYYIKKSSATRMVGIGSSPAGNPYVAQSATKM | | |
| AY029299 | 4598-6265 | gb:AY029299\|Organism:Avian paramyxovirus 6\|Strain Name:APMV-6/duck/Taiwan/Y1/98\|Protein Name:fusion protein\|Gene Symbol:F | MGARLGPLAMAPGRYVIIFNLILLHRVVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEAVLELKDATGQIAIALDKTQRFINDNILPAINNLTCEVAGAKVGVELSLYLTELSTVFGSQITNPALSTLSIQALMSLCGNDFNYLLNLMGAKHSDLGALYEANLINGRIIQYDQASQIMVIQVSVPSISSISGLRLTELFTLSIETPVGEGKAVVPQFVVESGQLLEEIDTQACTLTDTTAYCTIVRTKPLPELVAQCLRGDESRCQYTTGIGMLESRFGVFDGLVIANCKATICRCLAPEMIITQNKGLPLTVISQETCKRILIDGVTLQIEAQVSGSYSRNITVGNSQIAPSGPLDISSELGKVNQSLSNVEDLIDQSNQLLNRVNPNIVNNTAIIVTIVLLVLLVLWCLALTISILYVSKHAVRMIKTVPNPYVMQAKSPGSATQF | 11 | 640 |
| AY141760 | 5028-6665 | gb:AY141760\|Organism:Fer-de-Lance paramyxovirus\|Strain Name:ATCC VR-895\|Protein Name:fusion protein F\|Gene Symbol:F | MTRITILQIILTLTLPVMCQVSFDNLEQVGVMFDKPKFLKITGPASTATMIIKLIPTLGTMESCGTSAVNEYKKTLDTILVPLRDTINKLSTDITVVEGTSNISNKREKRFVGIAIAVGAVALATSAQITAGIALSNTIKNAEAIESIKSSIQASNQAIQKVIDAQGRTVTVINGIQDHINSVINPALNQLGCDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKVLEGHKITFNDKGSEWQTQVPSTIAVRDILIAGVDPDGCSITSTSYICKNDPTYAMSEVLTNCFRGNTQECPRARITSTFATRFAIARSTVIANCVAAVCLCGDPGIPVVQKAEVTLTAMTLDQCSLITVDGLQIKPSKSIANVTANFGNITLGPVVSVGDLDLSAELTKVQSDLKEAQDKLDESNAILQGINNKILTAPTSIALIVVSVVVILLIIGMISWLVWLTKAVRRSNTRSERVTPSAYNNLGFIK | 8 | 641 |
| EU877976 | 4330-6410 | gb:EU877976:4330-6410\|Organism:Avian paramyxovirus 4\|Strain Name:APMV-4/KR/YJ/06\| | MRLSRTILTLILGTLTGYLMGAHSTNVNEGPKSEGIRGDLIPGAGIFVTQVRQLQIYQQSGYHDLVIRLLPLLPAELNDCQREVVTEYNNTVSQLLQPIKTNLDTLLADGGTRDADIQPRFIGAIIATGALAVATVAEVTAAQALSQSKTNAQNILKLRD | 8 | 642 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | Protein Name:fusion protein\|Gene Symbol:F | SIQATNQAVFEISQGLEATATVLSKLQ TELNENIIPSLNNLSCAAMGNRLGVSL SLYLTLMTTLFGDQITNPVLTPISYSTL SAMAGGHIGPVMSKILAGSVTSQLGA EQLIASGLIQSQVVGYDSQYQLLVIRV NLVRIQEVQNTRVVSLRTLAVNRDGG LYRAQVPPEVVERSGIAERFYADDCV LTTTDYICSSIRSSRLNPELVKCLSGAL DSCTFERESALLSTPFFVYNKAVVAN CKAATCRCNKPPSIIAQYSASALVTITT DTCADLEIEGYRFNIQTESNSWVAPNF TVSTSQIVSVDPIDISSDIAKINSSIEAA REQLELSNQILSRINPRIVNDESLIAIIV TIVVLSLLVIGLIVVLGVMYKNLKKV QRAQAAMMMQQMSSSQPVTTKLGTP F | | |
| AB176531 | 4793-6448 | gb:AB176531:4793-6448\|Organism:Human parainfluenza virus 2\|Strain Name:Nishio\|Protein Name:fusion protein\|Gene Symbol:F | MHHLHPMIVCIFVMYTGIVGSDAIAG DQLLNIGVIQSKIRSLMYYTDGGASFI VVKLLPNLPPSNGTCNITSLDAYNVTL FKLLTPLIENLSKISTVTDTKTRQKRFA GVVVGLAALGVATAAQITAAVAIVK ANANAAAINNLASSIQSTNKAVSDVID ASRTIATAVQAIQDRINGAIVNGITSAS CRAHDALIGSILNLYLTELTTIFHNQIT NPALTPLSIQALRILLGSTLPIVIESKLN TNFNTAELLSSGLLTGQIISISPMYMQ MLIQINVPTFIMQPGAKVIDLIAISANH KLQEVVVQVPNRILEYANELQNYPAN DCVVTPNSVFCRYNEGSPIPESQYQCL RGNLNSCTFTPIIGNFLKRFAFANGVL YANCKSLLCRCADPPHVVSQDDTQGI SIIDIKRCSEMMLDTFSFRITSTFNATY VTDFSMINANIVHLSPLDLSNQINSINK SLKSAEDWIADSNFFANQARTAKTLY SLSAIALILSVITLVVVGLLIAYIIKLVS QIHQFRSLAATTMFHRENPAFFSKNN HGNIYGIS | 7 | 643 |
| BK005918 | 4677-6302 | gb:BK005918\|Orgaism:Porcine rubulavirus\|Strain Name:UNKNOWN-BK005918\|Protein Name:fusion protein\|Gene Symbol:F | MPQQQVAHTCVMLWGIISTVSGINTE ALSQYGVVVTNVRQLTYYTQAGSTY LAVRLLPSLASPDQSCALHSIINYNAT LQAILSPIAENLNLISTALREQHRKKRF AGVAIGLTALGVATAAQATAAVALV RANKNAEKVEQLSQALGETNAAISDL IDATKNLGFAVQAIQNQINTAILPQIH NLSCQVIDAQLGNILSLYLTELTTVFQ PQLTNPALSPLTIQALRAVLGTTLPAL LSEKLKSNIPLGDLMSSGLLKGQLVGL NLQNMLMIIELYIPTLSTHSTAKVLDL VTISSHVNGREVEIQVPNRVLELGSEV LGYGGSECALTMSHILCPFNDARVLS TDMKYCLQGNITHCIFSPVVGSFLRRF ALVNGVVIANCADMSCVCFDPQEIIY QNFQEPTTVIDIKKCGKVQLDTLTFTIS TFANRTYGPPAYVPPDNIIQSEPLDISG NLIAVNNSLSSALNHLATSEILRNEQI WTSSLGISTIVALVIIGILIICLVVTWAA LWALLKEVRGLNSAVNSQLSSYVMG DKFIRY | 7 | 644 |
| KC237063 | 4530-6185 | gb:KC237063:4530-6185\|Organism:Parainfluenza virus 5\|Strain Name:08-1990\|Protein Name:fusion | MGTRIQFLMVSCLLAGTGSLDPAALM QIGVIPTNVRQLMYYTEASSAFIVVKL MPTIDSPISGCNITSISSYNATMTKLLQ PIGENLETIRYQLIPTRRRRRFVGVVIG LAALGVATAAQVTAAVALVKANKN AAAILNLKNAIQKTNAAVADVVQAT QSLGTAVQAVQDHINSVVSPAITAAN | 7 | 645 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | protein\|Gene Symbol:F\| Segment: 4 | CKAQDAIIGSILNLYLTELTTIFHNQIT NPALSPITIQALRILLGSTLPTVVRKSF NTQISAAELLSSGLLTGQIVGLDLTYM QMVIKIELPTLTVQPATQIIDLVTISAFI NNREVMAQLPTRIIVTGSLIQAYPASQ CTITPNTVYCRYNDAQVLSDDTMACL QGNLTRCTFSPVVGSFLTRFVLFDGIV YANCRSMLCKCMQPAAVILQPSSSPV TVIDMHKCVSLQLDNLRFTITQLANIT YNSTIKLETSQILPIDPLDISQNLAAVN KSLSDALQHLAQSDTYLSAITSATTS VLSIIAICLGSLGLILIILISVVVWKLLTI VAANRNRMENFVYHNSAFHHSRSDL SEKNQPATLGTR | | |
| AY729016 | 5862-7523 | gb:AY729016:5862-7523\| Organism:Murine pneumonia virus\|Strain Name:15; ATCC VR-25\|Protein Name:fusion glycoprotein precursor\| Gene Symbol:F | MIPGRIFLVLLVIFNTKPIHPNTLTEKF YESTCSVETAGYKSALRTGWHMTVM SIKLSQINIESCKSSNSLLAHELAIYSSA VDELRTLSSNALKSKRKKRFLGLILGL GAAVTAGVALAKTVQLESEIALIRDA VRNTNEAVVSLTNGMSVLAKVVDDL KNFISKELLPKINRVSCDVHDITAVIRF QQLNKRLLEVSREFSSNAGLTHTVSSF MLTDRELTSIVGGMAVSAGQKEIMLS SKAIMRRNGLAILSSVNADTLVYVIQL PLFGVMDTDCWVIRSSIDCHNIADKY ACLARADNGWYCHNAGSLSYFPSPT DCEIHNGYAFCDTLKSLTVPVTSRECN SNMYTTNYDCKISTSKTYVSTAVLTT MGCLVSCYGHNSCTVINNDKGIIRTLP DGCHYISNKGVDRVQVGNTVYYLSK EVGKSIVVRGEPLVLKYDPLSFPDDKF DVAIRDVEHSINQTRTFLKASDQLLDL SENRENKNLNKSYILTTLLFVVMLIIIM AVIGFILYKVLKMIRDNKLKSKSTPGL TVLS | 6 | 646 |
| AB543336 | 5174-6805 | gb:AB543336:5174-6805\| Organism:Human parainfluenza virus 4a\|Strain Name:M-25\|Protein Name:fusion protein\|Gene Symbol:F | MGVKGLSLIMIGLLISPITNLDITHLMN LGTVPTAIRSLVYYTYTKPSYLTVDLI PNLKNLDQNCNYSSLNYYNKTALSLI QPIADNINRLTKPITSSEIQSRFFGAVIG TIALGVATAAQVTAAIGLAKAQENAK LILTLKKAATETNEAVRDLANSNKIV VKMISAIQNQINTIIQPAIDQINCQIKDL QVANILNLYLTEITTVFHNQLTNPALE SISIQALKSLLGPTLPEVLSKLDLNNIS AASVMASGLIKGQIIAVDIPTMTLVLM VQIPSISPLRQAKIIDLTSITIHTNSQEV QAVVPARFLEIGSEILGFDGSVCQITK DTIFCPYNDAYELPIQQKRCLQGQTRD CVFTPVAGTFPRRFLTTYGTIVANCRD LVCSCLRPPQIIYQPDENPVTIIDKDLC TTLTLDSITIEIQKSINSTFRREVVLEST QVRSLTPLDLSTDLNQYNQLLKSAED HIQRSTDYLNSINPSIVNNNAIIILIILCI LLILTVTICIIWLKYLTKEVKNVARNQ RLNRDADLFYKIPSQIPVPR | 5 | 647 |
| AF298895 | 4834-6450 | gb:AF298895\| Organism:Tioman virus\|Strain Name:UNKNOWN-AF298895\| Protein Name:fusion protein\|Gene Symbol:F | MRIALTAVIVSIHFDLAFPMNKNSLLS VGLVHKSVKNLYFYSQGSPSYIVVKL VPTLGNVPGNCTLNSLVRYKSTVSSL LSPLAENLEYLQKTLTVSRGGRRRRF AGVAIGLAALGVAAAAQATAAVALV EARQNAAQIQSLSEAIQNTNLAVNEL KTAIGASATAIQAIQTQINEVINPAINR LSCEILDAQLASMLNLYLIHLTTVFQN QLTNPALTPLSIQSLQSLLQGTSSVLTN ITSSSKLALNDALVTGLITGQVVGLN | 5 | 648 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | MTSLQIVIAAYVPSVAKLSNAVVHNFI RITTSVNGTEVIIQSPTIIMEQNEVMYD LKTGHCTESDLNIYCPYVDAQLLSPG MTNCINGRLNDCTFSKVVGSFPTRFA AVEGAILANCKYLQCNCLTPPYIITPL NGEMISMIDLSKCQRLDLGTIVFDINN PVNVTFNGNYRADVGQMIVTNPLDIS AELNQINTSLSNAQGFLSKSDAWLHV SQWVTNSGTIFIILIIGLIVGIVYMIINT YVVVQIIKEINRMRTSDRAHLLKGSIS SIST | | |
| FJ215863 | 4499-6130 | gb:FJ215863:4499-6130\|Organism:Avian paramyxovirus 8\|Strain Name:goose/Delaware/1053/76\|Protein Name:fusion protein\|Gene Symbol:F | MGQISVYLINSVLLLLVYPVNSIDNTLI APIGVASANEWQLAAYTTSLSGTIAV RFLPVLPDNMTTCLRETITTYNNTVN NILGPLKSNLDALLSSETYPQTRLIGA VIGSIALGVATSAQITAAVALKQAQD NARNILALKEALSKTNEAVKELSSGL QQTAIALGKIQSFVNEEILPSINQLSCE VTANKLGVYLSLYLTELTTIFGAQLTN PALTSLSYQALYNLCGGNMAMLTQKI GIKQQDVNSLYEAGLITGQVIGYDSQ YQLLVIQVNYPSISEVTGVRATELVTV SVTTDKGEGKAIVPQFVAESRVTIEEL DVASCKFSSTTLYCRQVNTRALPPLV ASCLRGNYDDCQYTTEIGALSSRYITL DGGVLVNCKSIVCRCLNPSKIISQNTN AAVTYVDATICKTIQLDDIQLQLEGSL SSVYARNISIEISQVTTSGSLDISSEIGNI NNTVNRVEDLIHQSEEWLAKVNPHIV NNTTLIVLCVLSALAVIWLAVLTAIIIY LRTKLKTISALAVTNTIQSNPYVNQTK RESKF | 5 | 649 |
| JN689227 | 4689-6521 | gb:JN689227:4689-6521\|Organism:Tailam virus\|Strain Name:TL8K\|Protein Name:fusion protein\|Gene Symbol:F | MKLSVVYTTLLVSTFYSDLARSQLAL SELTKIGVIPGRSYDLKISTQASYQYM VVKLIPNLTGLNNCTNGTIEAYKKML NRLLSPIDAALRKMKDAVNDKPPESV GNVKFWGAVIGGVALGVATSAQITA GVALHNSIQNANAILALKDSIRQSNKA IQELQTAMSTTVVVLNALQDQINNQL VPAINSLGCQVVANTLGLKLNQYFSEI SLVFGPNLRDPTSETLSIQALSRAFNG DFDSMLSKLKYDDSDFLDLLESDSIRG RIIDVSLSDYLITIQIEYPALLSIKDAVI QTFNLISYNTRGTEWISIFPKQLLVRGT YISNIDISQCVIAATSIICKSDTSTPISSA TWSCATGNITNCARTRVVNAHVPRFA LYGGVVFANCAPVVCKCQDPLYSINQ EPKVTNVMVDVDACKEMYLDGLYIT LGKTQISRAMYAEDVSLGGPISVDPID LGNEINSINSAINRSEEHLNHANELLD KVNPRIVNVKTFGVMIGLLVLVVLWC VITLVWLICLTKQLARTAYAGSMGSR ASTVNSLSGFVG | 5 | 650 |
| JX857409 | 4831-6615 | gb:JX857409:4831-6615\|Organism:Porcine parainfluenza virus 1\|Strain Name:S206N\|Protein Name:fusion protein\|Gene Symbol:F | MQVTTLRPAIILSIALLVTGQVPRDKL ANLGIIIKDSKALKIAGSYENRYIVLSL VPTIDNVNGCGSIQIAKYKEMLERLLI PIKDALDLQESLIVIDNETVNNNYSPQ YRFVGAIIGTIALGVATAAQVTAGVA LMEAREAKRDISMLKEAIEKTQNSIEK LQNSAGEQILALKMLQDYVNGEIKPA IEELGCETAALKLGIALTQHYTELTNA FGSNLGSIGEKSLTLQALSSLYKTNITN ILTATNLGKTDIYDIIYAEQVKGRVID VDLKRYMVTISVKIPILSEIPGVLIYEV SSISYNIDGAEWYAAVPDHILSKSAYI | 5 | 651 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | GGADISDCIESRLTYICPQDPAQIIADN QQQCFFGHLDKCPITKVIDNLVPKFAF INGGVVANCIASTCTCGEERIQVSQDR NKGVTFLTHNNCGLIGINGIEFHANKK GSDATWNVSPIGVGPAVSLRPVDISLQ IVAATNFLNSSRKDLMKAKEILNQVG NLKDLTTITIINIVIIIILLICVIGLGILYH QLRSALGMRDKMSVLNNSSYSLEPRT AQVQVIKPTSFMG | | |
| AY640317 | 2932-4571 | gb:AY640317:2932-4571\|Organism:Avian metapneumovirus\|Strain Name:LAHA\|Protein Name:F\|Gene Symbol:F | MDVRICLLLFLISNPSSCIQETYNEESC STVTRGYKSVLRTGWYTNVFNLEIGN VENITCNDGPSLIDTELVLTKNALREL KTVSADQVAKESRLSSPRRRRFVLGAI ALGVATAAAVTAGVALAKTIRLEGEV KAIKNALRNTNEAVSTLGNGVRVLAT AVNDLKEFISKKLTPAINQNKCNIADI KMAISFGQNNRRFLNVVRQFSDSAGI TSAVSLDLMTDDELVRAINRMPTSSG QISLMLNNRAMVRRKGFGILIGVYDG TVVYMVQLPIFGVIETPCWRVVAAPL CRKRRGNYACILREDQGWYCTNAGS TAYYPNKDDCEVRDDYVFCDTAAGI NVALEVDQCNYNISTSKYPCKVSTGR HPVSMVALTPLGGLVSCYESVSCSIGS NKVGIIKQLGKGCTHIPNNEADTITID NTVYQLSKVVGEQRTIKGAPVVNNFN PILFPVDQFNVALDQVFESIDRSQDLID KSNDLLGADAKSKAGIAIAIVVLVILG IFFLLAVIYYCSRVRKTKPKHDYPATT GHSSMAYVS | 4 | 652 |
| KU646513 | 4641-6498 | gb:KU646513:4641-6498\|Organism:Avian paramyxovirus 13 goose/Kazakhstan/5751/2013\|Strain Name:APMV-13/white fronted goose/Northern Kazakhstan/5751/2013\|Protein Name:fusion protein\|Gene Symbol:F | MARFSWEIFRLSTILLIAQTCQGSIDGR LTLAAGIVPVGDRPISIYTSSQTGIIVV KLIPNLPDNKKDCAKQSLQSYNETLS RILTPLATAMSAIRGNSTTQVRENRLV GAIIGSVALGVATAAQITAATALIQAN QNAANIARLANSIAKTNEAVTDLTEG LGTLAIGVGKLQDYVNEQFNNTAVAI DCLTLESRLGIQLSLYLTELMGVFGNQ LTSPALTPITIQALYNLAGGNLNALLS RLGASETQLGSLINSGLIKGMPIMYDD ANKLLAVQVELPSIGKLNGARSTLLET LAVDTTRGPSSPIIPSAVIEIGGAMEEL DLSPCITTDLDMFCTKIISYPLSQSTLS CLNGNLSDCVFSRSEGVLSTPYMTIKG KIVANCKQVICRCMDPPQILSQNYGE ALLLIDENTCRSLELSGVILKLAGTYE SEYTRNLTVDPSQVIITGPLDISAELSK VNQSIDSAKENIAESNKFLSQVNVKLL SSSAMITYIVATVVCLIIAITGCVIGIYT LTKLKSQQKTLLWLGNNAEMHGSRS KTSF | 4 | 653 |
| AF326114 | 4818-6482 | gb:AF326114\|Organism:Menangle virus\|Strain Name:UNKNOWN-AF326114\|Protein Name:fusion protein\|Gene Symbol:F | MMPRVLGMIVLYLTHSQILCINRNTL YQIGLIHRSVKKVNFYSQGSPSYIVVK LVPTLAAIPPNCSIKSLQRYKETVTSLV QPISDNLGYLQDKLVTGQSRRRRRFA GVAIGLAALGVAAAAQATAAVALVE TRENAGKIQALSESIQNTNQAVHSLKT ALGFSATAIQAIQNQVNEVINPAINKL SCEVLDSQLASMLNLYLIHLTTVFQTQ LTNPALTPLSIQALTSVLQGTSGVLMN STNSTLTQPIDLLATGLITGQIISVNMT SLQLIIATFMPSIAELPNAVLHSFFRITT SVNLTEVMIQSPEFIMEQNGVFYDFNT AHCQLGDNNVYCPYIDAARLSSMMT NCINGNLGECVFSRVIGSFPSRFVSLN | 3 | 654 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | GAILANCKFMRCNCLSPEKIITPLDGE MISLIDLRVCQKLTLGTITFEISQPVNV SFQGGFVANAGQIIVTNPFDISAELGQI NNSLNDAQGFLDQSNNWLKVSGWIN NSGSLFIAGIVVIGLIVLCIVIIIYINVQII REVNRLRSFIYRDYVLDHDKAPYSPES SSPHRKSLKTVS | | |
| GU206351 | 5441-7468 | gb:GU206351:5441-7468\|Organism:Avian paramyxovirus 5\|Strain Name:budgerigar/Kunitachi/74\|Protein Name:fusion protein\|Gene Symbol:F | MLQLPLTILLSILSAHQSLCLDNSKLIH AGIMSTTEREVNVYAQSITGSIVVRLIP NIPSNHKSCATSQIKLYNDTLTRLLTPI KANLEGLISAVSQDQSQNSGKRKKRF VGAVIGAAALGLATAAQVTATVALN QAQENARNILRLKNSIQKTNEAVMEL KDAVGQTAVAIDKTQAFINNQILPAIS NLSCEVLGNKIGVQLSLYLTELTTVFG NQLTNPALTTLSLQALYNLCGDDFNY LINLLNAKNRNLASLYEANLIQGRITQ YDSMNQLLIIQVQIPSISTVSGMRVTEL FTLSVDTPIGEGKALVPKYVLSSGRIM EEVDLSSCAITSTSVFCSSIISRPLPLETI NCLNGNVTQCQFTANTGTLESRYAVI GGLVIANCKAIVCRCLNPPGVIAQNLG LPITIISSNTCQRINLEQITLSLGNSILST YSANLSQVEMNLAPSNPLDISVELNR VNTSLSKVESLIKESNSILDSVNPQILN VKTVIILAVIIGLIVVWCFILTCLIVRGF MLLVKQQKFKGLSVQNNPYVSNNSH | 3 | 655 |
| JQ001776 | 6129-8166 | gb:JQ001776:6129-8166\|Organism:Cedar virus\|Strain Name:CG1a\|Protein Name:fusion glycoprotein\|Gene Symbol:F | MSNKRTTVLIIISYTLFYLNNAAIVGFD FDKLNKIGVVQGRVLNYKIKGDPMTK DLVLKFIPNIVNITECVREPLSRYNETV RRLLLPIHNMLGLYLNNTNAKMTGL MIAGVIMGGIAIGIATAAQITAGFALY EAKKNTENIQKLTDSIMKTQDSIDKLT DSVGTSILILNKLQTYINNQLVPNLELL SCRQNKIEFDLMLTKYLVDLMTVIGP NINNPVNKDMTIQSLSLLFDGNYDIM MSELGYTPQDFLDLIESKSITGQIIYVD MENLYVVIRTYLPTLIEVPDAQIYEFN KITMSSNGGEYLSTIPNFILIRGNYMSN IDVATCYMTKASVICNQDYSLPMSQN LRSCYQGETEYCPVEAVIASHSPRFAL TNGVIFANCINTICRCQDNGKTITQNIN QFVSMIDNSTCNDVMVDKFTIKVGKY MGRKDINNINIQIGPQIIIDKVDLSNEIN KNINQSLKDSIFYLREAKRILDSVNISLI SPSVQLFLIIISVLSFIILLIIIVYLYCKSK HSYKYNKFIDDPDYYNDYKRERINGK ASKSNNIYYVGD | 3 | 656 |
| LC168749 | 4869-7235 | gb:LC168749:4869-7235\|Organism:Rinderpest morbillivirus\|Strain Name:Lv\|Protein Name:F protein\|Gene Symbol:F | MGILFAALLAMTNPHLATGQIHWGNL SKIGVVGTGSASYKVMTQSSHQSLVI KLMPNVTAIDNCTKTEIMEYKRLLGT VLKPIREALNAITKNIKPIQSSTTSRRH KRFAGVVLAGAALGVATAAQITAGIA LHQSMMNSQAIESLKASLETTNQAIEE IRQAGQEMVLAVQGVQDYINNELVP AMGQLSCEIVGQKLGLKLLRYYTEILS LFGPSLRDPVSAELSIQALSYALGGDI NKILEKLGYSGSDLLAILESKGIKAKIT YVDIESYFIVLSIAYPSLSEIKGVIVHRL ESVSYNIGSQEWYTTVPRYVATQGYL ISNFDDTPCAFTPEGTICSQNALYPMSP LLQECFRGSTRSCARTLVSGSIGNRFIL SKGNLIANCASILCKCYTTGSIISQDPD KILTYIAADQCPVVEVGGVTIQVGSRE YSDAVYLHEIDLGPPISLEKLDVGTNL | 2 | 657 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | WNAVTKLEKAKDLLDSSDLILENIKG VSVTNTGYILVGVGLIAVVGILIITCCC KKRRSDNKVSTMVLNPGLRPDLTGTS KSYVRSL | | |
| LC187310 | 6250-7860 | gb:LC187310:6250-7860\|Organism:Avian paramyxovirus 10\|Strain Name:rAP MV-10-FI324/YmHA\|Protein Name:fusion protein\|Gene Symbol:F | MTRTRLLFLLTCYIPGAVSLDNSILAP AGIISASERQIAIYTQTLQGTIALRFIPV LPQNLSSCAKDTLESYNSTVSNLLLPI AENLNALLKDADKPSQRIIGAIIGSVA LGVATTAQVTAALAMTQAQQNARNI WKLKESIKNTNQAVLELKDGLQQSAI ALDKVQSFINSEILPQINQLGCEVAAN KLGIFLSLYLTEITTVFKNQITNPALST LSYQALYNLCGGNMAALTKQIGIKDT EINSLYEAELITGQVIGYDSADQILLIQ VSYPSVSRVQGVRAVELLTVSVATPK GEGKAIAPSFIAQSNIIAEELDTQPCKF SKTTLYCRQVNTRTLPVRVANCLKGK YNDCQYTTEIGALASRYVTITNGVVA NCRSIICRCLDPEGIVAQNSDAAITVID RSTCKLIQLGDITLRLEGKLSSSYSKNI TIDISQVTTSGSLDISSELGSINNTITKV EDLISKSNDWLSKVNPTLISNDTIIALC VIAGIVVIWLVIITILSYYILIKLKNVAL LSTMPKKDLNPYVNNTKF | 2 | 658 |
| NC_005283 | 5277-6935 | gb:NC_005283:5277-6935\|Organism:Dolphin morbillivirus\|Strain Name:UNKNOWN-NC_005283\|Protein Name:fusion protein\|Gene Symbol:F | MAASNGGVMYQSFLTIIILVIMTEGQI HWGNLSKIGIVGTGSASYKVMTRPNH QYLVIKLMPNVTMIDNCTRTEVTEYR KLLKTVLEPVKNALTVITKNIKPIQSLT TSRRSKRFAGVVLAGVALGVATAAQI TAGVALHQSIMNSQSIDNLRTSLEKSN QAIEEIRQASQETVLAVQGVQDFINNE LIPSMHQLSCEMLGQKLGLKLLRYYT EILSIFGPSLRDPVSAEISIQALSYALGG DINKILEKLGYSGADLLAILESRGIKA KVTHVDLEGYFIVLSIAYPTLSEVKGV IVHKLEAVSYNLGSQEWYTTLPKYVA TNGYLISNFDESSCAFMSEVTICSQNA LYPMSPLLQQCLRGSTASCARSLVSG TIGNRFILSKGNLIANCASVLCKCYST GTIISQDPDKLLTFVAADKCPLVEVDG ITIQVGSREYPDSVYVSRIDLGPAISLE KLDVGTNLGSALTKLDNAKDLLDSSN QILENVRRSSFGGAMYIGILVCAGALV ILCVLVYCCRRHCRKRVQTPPKATPG LKPDLTGTTKSYVRSL | 2 | 659 |
| NC_005339 | 5374-7602 | gb:NC_005339:5374-7602\|Organism:Mossman virus\|Strain Name:UNKNOWN-NC_005339\|Protein Name:fusion protein\|Gene Symbol:F | MSNYFPARVIIIVSLITAVSCQISFQNLS TIGVFKFKEYDYRVSGDYNEQFLAIK MVPNVTGVENCTASLIDEYRHVIYNL LQPINTTLTASTSNVDPYAGNKKFFGA VIAGVALGVATAAQVTAGVALYEAR QNAAAIAEIKESLHYTHKAIESLQISQ KQTVVAIQGIQDQINTNIIPQINALTCEI ANQRLRLMLLQYYTEMLSSFGPIIQDP LSGHITVQALSQAAGGNITGLMRELG YSSKDLRYILSVNGISANIIDADPEIGSI ILRIRYPSMIKIPDVAVMELSYLAYHA AGGDWLTVGPRFILKRGYSLSNLDITS CTIGEDFLLCSKDVSSPMSLATQSCLR GDTQMCSRTAVQDREAPRFLLLQGNL IVNCMSVNCKCEDPEETITQDPAYPL MVLGSDTCKIHYIDGIRIKLGKVQLPPI TVLNTLSLGPIVVLNPIDVSNQLSLVE TTVKESEDHLKNAIGALRSQSRVGGV | 2 | 660 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | GIVAIVGLIIATVSLVVLVISGCCLVKY FSRTATLESSLTTIEHGPTLAPKSGPIIP TYINPVYRHD | | |
| NC_007454 | 4635-6384 | gb:NC_007454:4635-6384\|Organism:J-virus\|Strain Name:UNKNOWN-NC_007454\|Protein Name:fusion protein\|Gene Symbol:F | MKPVALIYLTILAFTVKVRSQLALSDL TKIGIIPAKSYELKISTQAAQQLMVIKL IPNVNGLTNCTIPVMDSYKKMLDRIL KPIDDALNHVKNAIQDKQGDGVPGV RFWGAIIGGVALGVATSAQITAGVAL HNSIQNANAILQLKESIRNSNKAIEELQ AGLQSTVLVINALQDQINSQLVPAINT LGCSVIANTLGLRLNQYFSEISLVFGP NLRDPTSQTLSIQAIAKAFNGDFDSM MKKMHYTDSDFLDLLESDSIRGRIISV SLEDYLIIIQIDYPGLTTIPNSVVQTFNL ITYNYKGTEWESIFPRELLIRGSYISNI DISQCVGTSKSMICKSDTSTTISPATW ACATGNLTSCARTRVVNSHSTRFALS GGVLFANCAPIACRCQDPQYSINQEPK TTNVMVTSEDCKELYIDGFYLTLGKK MLDRAMYAEDVALGGSVSVDPIDIGN ELNSINESINKSHEYLDKANELLEQVN PNIVNVSSFSFILVISILLIIWFIVTLVWL IYLTKHMNFIVGKVAMGSRSSTVNSL SGFVG | 2 | 661 |
| NC_009489 | 4620-6500 | gb:NC_009489:4620-6500\|Organism:Mapuera virus\|Strain Name:BeAnn 370284\|Protein Name:fusion protein\|Gene Symbol:F | MRSSLFLVLTLLVPFAHSIDSITLEQYG TVITSVRSLAYFLETNPTYISVRLMPAI QTDSSHCSYHSIENYNLTLTKLLLPLQ ENLHQITDSLSSRRRKKRFAGVAVGL AALGVATAAQVTAAIAVVKAKENSA KIAQLTSAISETNRAVQDLIEGSKQLA VAVQAIQDQINNVIQPQLTNLSCQVA DAQVGTILNMYLTELTTVFHPQITNSA LTPITIQALRSLLGSTLPQVVTSTIKTD VPLQDLLTSGLLKGQIVYLDLQSMIM VVSVSVPTIALHSMAKVYTLKAISAH VNNAEVQMQVPSRVMELGSEIMGYD IDQCEETSRYLFCPYNGGSILSATMKM CLNGNISQCVFTPIYGSFLQRFVLVDG VIVANCRDMTCACKSPSKIITQPDSLP VTIIDSTSCSNLVLDTLELPIISINNATY RPVQYVGPNQIIFSQPLDLLSQLGKINS SLSDAIEHLAKSDEILEQIQWDSPQGY TLIALTSVLAFVVVAIVGLLISTRYLIF EIRRINTTLTQQLSSYVLSNKIIQY | 2 | 662 |
| NC_017937 | 4534-6330 | gb:NC_017937:4534-6330\|Organism:Nariva virus\|Strain Name:UNKNOWN-NC_017937\|Protein Name:fusion protein\|Gene Symbol:F | MAEQEKTPLRYKILLIIIVINHYNITNV FGQIHLANLSSIGVFVTKTLDYRTTSD PTEQLLVINMLPNISNIQDCAQGVVNE YKHLISSLLTPINDTLDLITSNINPYSGR NKLFGEIIAGAALTVATSAQITAGVAL YEARQNAKDIAAIKESLGYAYKAIDK LTTATREITVVINELQDQINNRLIPRIN DLACEVWATRLQAMLLQYYAEIFSVI GPNLQDPLSGKISIQALARAAGGNIKL MVDELNYSGQDLSRLVKVGAIKGQII DADPSLGVVIIKMRYPNIIKIPNVAISE LSYVSYSSDGQDWITTGPNYIVTRGYS IANIQTSSCSVGDDFVLCDRDMTYPM SQVTQDCLRGNIALCSRMVVRDREAP RYLILQGNMVANCMSITCRCEEPESEI YQSPDQPLTLLTRDTCDTHVVDGIRIR LGVRKLPTISVINNITLGPIITTDPIDVS NQLNAVVSTIDQSAELLHQAQRVLSE RARGARDHILATAAIVICVVLAVLILV LLIGLVYLYRTQNEILVKTTMLEQVPT FAPKSFPMESQIYSGKTNKGYDPAE | 2 | 663 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| NC_025256 | 6865-8853 | gb:NC_025256:6865-8853\|Organism:Bat Paramyxovirus Eid_hel/GH-M74a/GHA/2009\|Strain Name:Bat PV/Eid_hel/GH-M74a/GHA/2009\|Protein Name:fusion protein\|Gene Symbol:F | MKKKTDNPTISKRGHNHSRGIKSRAL LRETDNYSNGLIVENLVRNCHHPSKN NLNYTKTQKRDSTIPYRVEERKGHYP KIKHLIDKSYKHIKRGKRRNGHNGNII TIILLLILILKTQMSEGAIHYETLSKIGLI KGITREYKVKGTPSSKDIVIKLIPNVTG LNKCTNISMENYKEQLDKILIPINNIIE LYANSTKSAPGNARFAGVIIAGVALG VAAAAQITAGIALHEARQNAERINLL KDSISATNNAVAELQEATGGIVNVITG MQDYINTNLVPQIDKLQCSQIKTALDI SLSQYYSEILTVFGPNLQNPVTTSMSI QAISQSFGGNIDLLLNLLGYTANDLLD LLESKSITGQITYINLEHYFMVIRVYYP IMTTISNAYVQELIKISFNVDGSEWVS LVPSYILIRNSYLSNIDISECLITKNSVI CRHDFAMPMSYTLKECLTGDTEKCPR EAVVTSYVPRFAISGGVIYANCLSTTC QCYQTGKVIAQDGSQTLMMIDNQTCS IVRIEEILISTGKYLGSQEYNTMHVSV GNPVFTDKLDITSQISNINQSIEQSKFY LDKSKAILDKINLNLIGSVPISILFIIAIL SLILSIITFVIVMIIVRRYNKYTPLINSDP SSRRSTIQDVYIIPNPGEHSIRSAARSID RDRD | 2 | 664 |
| NC_025347 | 4471-6386 | gb:NC_025347:4471-6386\|Organism:Avian paramyxovirus 7\|Strain Name:APMV-7/dove/Tennessee/4/75\|Protein Name:fusion protein\|Gene Symbol:F | MRVRPLIIILVLLVLLWLNILPVIGLDN SKIAQAGIISAQEYAVNVYSQSNEAYI ALRTVPYIPPHNLSCFQDLINTYNTTIQ NIFSPIQDQITSITSASTLPSSRFAGLVV GAIALGVATSAQITAAVALTKAQQNA QEIIRLRDSIQNTINAVNDITVGLSSIGV ALSKVQNYLNDVINPALQNLSCQVSA LNLGIQLNLYLTEITTIFGPQITNPSLTP LSIQALYTLAGDNLMQFLTRYGYGET SVSSILESGLISAQIVSFDKQTGIAILYV TLPSIATLSGSRVTKLMSVSVQTGVGE GSAIVPSYVIQQGTVIEEFIPDSCIFTRS DVYCTQLYSKLLPDSILQCLQGSMAD CQFTRSLGSFANRFMTVAGGVIANCQ TVLCRCYNPVMIIPQNNGIAVTLIDGS LCKELELEGIRLTMADPVFASYSRDLII NGNQFAPSDALDISSELGQLNNSISSA TDNLQKAQESLNKSIIPAATSSWLIILL FVLVSISLVIGCISIYFIYKHSTTNRSRN LSSDIISNPYIQKAN | 2 | 665 |
| NC_025348 | 4790-6570 | gb:NC_025348:4790-6570\|Organism:Tuhoko virus 2\|Strain Name:UNKNOWN-NC_025348\|Protein Name:fusion protein\|Gene Symbol:F | MAPCVLFLSSLLLISTISPSHGINQPAL RRIGAIVSSVKQLKFYSKTKPNYIIVKL LPTINLSKSNCNLTSINRYKESVIEIIKP LADNIDNLNQKLLPKNRRKRMAGVAI GLAALGVAAAAQATAAVALVEARKN TQMIQSLADSIQDTNAAVQAVNIGLQ NSAVAIQAIQNQINNVINPALDRLNCE VLDAQIASILNLYLIKSVTIFQNQLTNP ALQQLSIQMLSIVMQDTAKILGNFTIG DKFDQHDLLGSGLITGQVVGVNLTNL QLIIAAFIPSIAPLPQAYIIDLISITISVND TEAVIQIPERIMEHGSSIYQFGGKQCV YGQFSAYCPFSDAVLMTQDLQLCMK GNIEHCIFSSVLGSFPNRFASVDGVFY ANCKYMSCACSDPLQVIHQDDSVNL MVIDSSVCRSLTLGHVTFPIIAFSNVSY QMKTNISIEQMIVTSPLDLSTELKQINN SVNIANTFLDSSNRALKTSIFGTSSQIIL IVLLIFTCLLILYVIFLTYIIKILIKEVKR LRDGNSRTGSKLSFINPDV | 2 | 666 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| NC_025350 | 4663-6428 | gb:NC_025350:4663-6428\|Organism:Tuhoko virus 3\|Strain Name:UNKNOWN-NC_025350\|Protein Name:fusion protein\|Gene Symbol:F | MLWLTILIALVGNHESTCMNINFLQSLGQINSQKRFLNFYTQQPPSYMVIRLVPTLQLSANNCTLGSIVRYRNAIKELIQPMDENLRWLSSNLIPQRRGKRFAGVAVGLAALGVAVAAQATAAVALVEARANAEKIASMSQSIQETNKAVTSLSQAVSASGIAIQAIQNEINNVIHPILNQVQCDVLDARVGNILNLYLIKVTTIFQNQLTNPALQRLSTQALSMLMQSTSSYLRNLSSSESAINADLSMTNLIEAQIVGINMTNLQLVLAVFIPSIARLNGALLYDFISITISSNQTEVMLQIPHRVLEIGNSLYTFEGTQCEMTKLNAYCLYSDAIPVTESLRDCMNGLFSQCGFVRIIGSFANRFASVNGVIYANCKHLTCSCLQPDEIITQDTNVPLTIIDTKRCTKISLGHLTFTIREYANVTYSLRTEIANSQITVVSPLDLSSQLTTINNSLADATNHIMNSDRILDRLNSGLYSKWVIIFLICASIVSLIGLVFLGFLIRGLILELRSKHRSNLNKASTYSIDSSIGLT | 2 | 667 |
| NC_025352 | 5950-8712 | gb:NC_025352:5950-8712\|Organism:Mojiang virus\|Strain Name:Tongguan1\|Protein Name:fusion protein\|Gene Symbol:F | MALNKNMFSSLFLGYLLVYATTVQSSIHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH | 2 | 668 |
| NC_025363 | 4622-6262 | gb:NC_025363:4622-6262\|Organism:Avian paramyxovirus 12\|Strain Name:Wigeon/Italy/3920_1/2005\|Protein Name:fusion protein\|Gene Symbol:F | MAIPVPSSTALMIFNILVSLAPASALDGRLLLGAGIVPTGDRQVNVYTSSQTGIIALKLLPNLPKDKENCAEVSIRSYNETLTRILTPLAQSMAAIRGNSTVSTRGREPRLVGAIIGGVALGVATAAQITAATALIQANQNAENIARLAKGLAATNEAVTDLTKGVGSLAIGVGKLQDYVNEQFNRTGEAIECLTIESRVGVQLSLYLTEVIGVFGDQITSPALSDISIQALYNLAGGNLNVLLQKMGIEGTQLGSLINSGLIKGRPIMYDDGNKILGIQVTLPSVGRINGARATLLEAIAVATPKGNASPLIPRAVISVGSLVEELDMTPCVLTPTDIFCTRILSYPLSDSLTTCLKGNLSSCVFSRTEGALSTPYVSVHGKIVANCKSVVCRCVEPQQIISQNYGEALSLIDESLCRILELNGVILKMDGQFTSEYTKNITIDPVQVIISGPIDISSELSQVNQSLDSALENIKESNSYLSKVNVKLISSSAMITYIVITVICLILTFVALVLGIYSYTKIRSQQKTLIWMGNNIARSKEGNRF | 2 | 669 |
| NC_025373 | 4617-6582 | gb:NC_025373:4617-6582\|Organism:Avian | MASPMVPLLIITVVPALISSQSANIDKLIQAGIIMGSGKELHIYQESGSLDLYLR | 2 | 670 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | paramyxovirus 3\|Strain Name:turkey/ Wisconsin/ 68\|Protein Name:fusion protein\|Gene Symbol:F | LLPVIPSNLSHCQSEVITQYNSTVTRLL SPIAKNLNHLLQPRPSGRLFGAVIGSIA LGVATSAQISAAIALVRAQQNANDIL ALKAAIQSSNEAIKQLTYGQEKQLLAI SKIQKAVNEQVIPALTALDCAVLGNK LAAQLNLYLIEMTTIFGDQINNPVLTPI PLSYLLRLTGSELNDVLLQQTRSSLSLI HLVSKGLLSGQIIGYDPSVQGIIIRIGLI RTQRIDRSLVFXPYVLPITISSNIATPIIP DCVVKKGVIIEGMLKSNCIELERDIIC KTINTYQITKETRACLQGNITMCKYQ QSRTQLSTPFITYNGVVIANCDLVSCR CIRPPMIITQVKGYPLTIINRNLCTELS VDNLILNIETNHNFSLNPTIIDSQSRLIA TSPLEIDALIQDAQHHAAAALLKVEES NAHLLRVTGLGSSSWHIILILTLLVCTI AWLIGLSIYVCRIKNDDSTDKEPTTQS SNRGIGVGSIQYMT | | |
| NC_025386 | 5548-7206 | gb:NC_025386:5548-7206\| Organism:Salem virus\|Strain Name:UNKNOWN- NC_025386\| Protein Name:fusion protein\|Gene Symbol:F | MNPLNQTLIAKVLGFLLLSSSFTVGQI GFENLTRIGVHQVKQYGYKLAHYNS HQLLLIRMIPTVNGTHNCTHQVITRYR EMVREIITPIKGALDIMKKAVSPDLVG ARIFGAIVAGAALGIATSAQITAGVAL HRTKLNGQEISKLKEAVSLTNEAVEQ LQYSQGKSILAIQGIQDFINFNVVPLLE EHTCGIAKLHLEMALMEYFQKLILVF GPNLRDPIGSTIGIQALATLFQNNMFE VSLRLGYAGDDLEDVLQSNSIRANIIE AEPDSGFIVLAIRYPTLTLVEDQVITEL AHITFNDGPQEWVATIPQFVTYRGLV LANIDVSTCTFTERNVICARDQTYPMII DLQLCMRGNIAKCGRTRVTGSTASRF LLKDGNMYANCIATMCRCMSSSSIIN QEPSHLTTLIVKETCSEVMIDTIRITLG ERKHPPIDYQTTITLGQPIALAPLDVGT ELANAVSYLNKSKVLLEHSNEVLSSV STAHTSLTATIVLGIVVGGLAILIVVMF LFLEAQVIKVQRAMMLCPITNHGYLP NEDLLTRGHSIPTIG | 2 | 671 |
| NC_025390 | 4805-6460 | gb:NC_025390:4805-6460\| Organism:Avian paramyxovirus 9\|Strain Name:duck/New York/22/ 1978\|Protein Name:fusion protein\|Gene Symbol:F | MGYFHLLLILTAIAISAHLCYTTTLDG RKLLGAGIVITEEKQVRVYTAAQSGTI VLRSFRVVSLDRYSCMESTIESYNKTV YNILAPLGDAIRRIQASGVSVERIREGR IFGAILGGVALGVATAAQITAAIALIQ ANENAKNILRIKDSITKTNEAVRDVTN GVSQLTIAVGKLQDFVNKEFNKTTEAI NCVQAAQQLGVELSLYLTEITTVFGP QITSPALSKLTIQALYNLAGVSLDVLL GRLGADNSQLSSLVSSGLITGQPILYD SESQILALQVSLPSISDLRGVRATYLDT LAVNTAAGLASAMIPKVVIQSNNIVEE LDTTACIAAEADLYCTRITTFPIASAVS ACILGDVSQCLYSKTNGVLTTPYVAV KGKIVANCKHVTCRCVDPTSIISQNYG EAATLIDDQLCKVINLDGVSIQLSGTF ESTYVRNVSISANKVIVSSSIDISNELE NVNSSLSSALEKLDESDAALSKVNVH LTSTSAMATYIVLTVIALILGFVGLGL GCFAMIKVKSQAKTLLWLGAHADRS YILQSKPAQSST | 2 | 672 |
| NC_025403 | 4826-6649 | gb:NC_025403:4826-6649\| Organism:Achimota virus 1\|Strain Name:UNKNOWN- | MWIMIILSLFQIIPGVTPINSKVLTQLG VITKHTRQLKFYSHSTPSYLVVKLVPT INTESTVCNFTSLSRYKDSVRELITPLA KNIDNLNSILTIPKRRKRMAGVVIGLA ALGVAAAAQATAAVALIEAKKNTEQI | 2 | 673 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | NC_025403\|Protein Name:fusion protein\|Gene Symbol:F | QALSESIQNTNKAVSSIEKGLSSAAIAVQAIQNQINNVINPALTALDCGVTDAQLGNILNLYLIKTLTVFQKQITNPALQPLSIQALNIIMQETSSVLRNFTKTDEIEHTDLLTSGLITGQVVGVNLTNLQLIIAAFIPSIAPLNQAYILDFIRITVNINNSESMIQIPERIMEHGISLYQFGGDQCTFSDWSAYCPYSDATLMAPGLQNCFRGQAADCVFSTVMGSFPNRFVSVQGVFYVNCKFIRCACTQPQRLITQDDSLSLTQIDAKTCRMLTLGFVQFSINEYANVTYSFKNNVTAGQLIMTNPIDLSTEIKQMNDSVDEAARYIEKSNAALNKLMYGGRSDIVTTVLLVGFILLVVYVIFVTYILKILMKEVARLRNSNHPDLIKPYNYPM | | |
| NC_025404 | 4772-6647 | gb:NC_025404:4772-6647\|Organism:Achimota virus 2\|Strain Name:UNKNOWN-NC_025404\|Protein Name:fusion protein\|Gene Symbol:F | MLNSFYQIICLAVCLTTYTVISIDQHNLLKAGVIVKSIKGLNFYSRGQANYIIVKLIPNVNVTDTDCDIGSIKRYNETVYSLIKPLADNIDYLRTQFAPTKRKKRFAGVAIGLTALGVATAAQVTAAVALVKAQENARKLDALADSIQATNEAVQDLSTGLQAGAIAIQAIQSEINHVINPALERLSCEIIDTRVASILNLYLIRLTTVFHRQLVNPALTPLSIQALNHLLQGETEGLVKNESKMTDSKIDLLMSGLITGQVVGVNIKHMQLMIAVFVPTTAQLPNAYVINLLTITANINNSEVLVQLPNQILERSGIIYQFRGKDCVSSPNHMYCPYSDASILSPELQLCLQGRLEMCLFTQVVGSFPTRFASDKGIVYANCRHLQCACSEPEGIIYQDDTSAITQIDASKCSTLKLDMLTFKLSTYANKTFDASFSVGKDQMLVTNLLDLSAELKTMNASVAHANKLIDKSNLLIQSNALIGHSNTIFIVVIVILAVMVLYLIIVTYIIKVIMVEVSRLKRMNIYSIDK | 2 | 674 |
| NC_025410 | 4958-6751 | gb:NC_025410:4958-6751\|Organism:Tuhoko virus 1\|Strain Name:UNKNOWN-NC_025410\|Protein Name:fusion protein\|Gene Symbol:F | MVTIIKPLILLVTVILQISGHIDTTALTSIGAVIASSKEIMYYAQSTPNYIVIKLIPNLPNIPSQCNFSSIAYYNKTLLDLFTPISDNINMLHQRLSNTGRNRRFAGVAIGLAALGVATAAQVTAAFALVEAKSNTAKIAQIGQAIQNTNAAINSLNAGIGGAVTAIQAIQTQINGIITDQINAATCTALDAQIGTLLNMYLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVIIANCKFIRCTCLQPEGIISQLDDHTLTVIDLKLCNKLDLGLIQFDLQVLSNISYEMTLNTSQNQLILTDPLDLSSELQTMNQSINNAANFIEKSNSLLNSSTYEFNRSVALLVALILLSLTILYVIVLTCVVKLLVHEVSKNRRHIQDLESHHK | 2 | 675 |
| NC_028249 | 4850-7055 | gb:NC_028249:4850-7055\|Organism:Phocme distemper virus\|Strain Name:PDV/Wadden_Sea.NLD/1988\|Protein Name:fusion protein\|Gene Symbol:F | MTRVKKLPVPTNPPMHHSLDSPFLNPEHATGKISITDDTSSQLTNFLYHKYHKTTINHLSRTISGTDPPSAKLNKFGSPILSTYQIRSALWWIAMVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNN | 2 | 676 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | | EIVPALQHMSCELIGQRLGLKLLRYYT ELLSVFGPSLRDPVSAEISIQALSYALG GEIHKILEKLGYSGNDMVAILETKGIR AKITHVDLSGKFIVLSISYPTLSEVKGV VVHRLEAVSYNIGSQEWYTTVPRYVA TNGYLISNFDESSCVFVSESAICSQNSL YPMSPILQQCLRGETASCARTLVSGTL GNKFILSKGNIIANCASILCKCHSTSKII NQSPDKLLTFIASDTCSLVEIDGVTIQV GSRQYPDVVYASKVILGPAISLERLDV GTNLGSALKKLNDAKVLIESSDQILDT VKNSYLSLGTLIALPVSIGLGLILLLLIC CCKKRYQHLFSQSTKVAPVFKPDLTG TSKSYVRSL | | |
| NC_028362 | 5217-6842 | gb:NC_028362:5217-6842\|Organism:Caprme parainfluenza virus 3\|Strain Name:JS2013\|Protein Name:fusion protein\|Gene Symbol:F | MIKKIICIFSMPILLSFCQVDIIKLQRVG ILVSKPKSIKISQNFETRYLVLNLIPNIE NAQSCGDQQIKQYKKLLDRLIIPLYDG LRLQQDIIVVDNNLKNNTNHRAKRFF GEIIGTIALGVATSAQITAAVALVEAK QARSDIERVKNAVRDTNKAVQSIQGS VGNLIVAVKSVQDYVNNEIVPSIKRLG CEAAGLQLGIALTQHYSELTNIFGDNI GTLKEKGIKLQGIASLYHTNITEIFTTS TVDQYDIYDLLFTESIKMRVIDVDLND YSITLQVRLPLLTKISDAQIYNVDSVS YNIGGTEWYIPLPRNIMTKGAFLGGA NLQDCIESFSDYICPSDPGFILNRDIEN CLSGNITQCPKTLVISDIVPRYAFVDG GVIANCLSTTCTCNGIDNRINQAPDQG IKIITYKDCQTIGINGMLFKTNQEGTLA AYTPVDITLNNSVNLDPIDLSIELNRA RSDLAESKEWIKRSEAKLDSVGSWYQ SSTTEIIQIVMIIVLFIINIIVLIVLIKYSRS QNQSMNNHMNEPYILTNKVQ | 2 | 677 |
| AF079780 | 5919-7580 | gb:AF079780\|Organism:Tupaia paramyxovirus\|Strain Name:UNKNOWN-AF079780\|Protein Name:fusion protein\|Gene Symbol:F | MASLLKTICYIYLITYAKLEPTPKSQL DLDSLASIGVVDAGKYNYKLMTTGSE KLMVIKLVPNITYATNCNLTAHTAYT KMIERLLTPINQSLYEMRSVITERDGG TIFWGAIIAGAALGVATAAAITAGVAL HRAEQNARNIAALKDALRNSNEAIQH LKDAQGHTVLAIQGLQEQINNNIIPKL KESHCLGVNNQLGLLLNQYYSEILTV FGPNLQNPVSASLTIQAIAKAFNGDFN SLMTNLNYDPTDLLDILESNSINGRIID VNLNEKYIALSIEIPNFITLTDAKIQTFN RITYGYGSNEWLTLIPDNILEYGNLISN VDLTSCVKTKSSYICNQDTSYPISSELT RCLRGDTSSCPRTPVVNSRAPTFALSG GHIYANCAKAACRCEKPPMAIVQPAT STLTFLTEKECQEVVIDQINIQLAPNRL NKTIITDGIDLGPEVIINPIDVSAELGNI ELEMDKTQKALDRSNKILDSMITEVT PDKLLIAMIVVFGILLLWLFGVSYYAF KIWSKLHFLDSYVYSLRNPSHHRSNG HQNHSFSTDISG | 1 | 678 |
| EU403085 | 4664-6585 | gb:EU403085:4664-6585\|Organism:Avian paramyxovirus 3\|Strain Name:APMV3/PKT/Netherland/449/75\|Protein Name:fusion | MQPGSALHLPHLYIIIALVSDGTLGQT AKIDRLIQAGIVLGSGKELHISQDSGTL DLFVRLLPVLPSNLSHCQLEAITQYNK TVTRLLAPIGKNLEQVLQARPRGRLF GPIIGSIALGVATSAQITAAIALVRAQQ NANDILALKNALQSSNEAIRQLTYGQ DKQLLAISKIQKAVNEQILPALDQLDC AVLGTKLAVQLNLYLIEMTTIFGEQIN NPVLATIPLSYILRLTGAELNNVLMKQ ARSSLSLVQLVSKGLLSGQVIGYDPSV | 1 | 679 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | protein\|Gene Symbol:F | QGLIIRVNLMRTQKIDRALVYQPYVLP ITLNSNIVTPIAPECVIQKGTIIEGMSRK DCTELEQDIICRTVTTYTLARDTRLCL QGNISSCRYQQSGTQLHTPFITYNGAV IANCDLVSCRCLRPPMIITQVKGYPLTI ITRSVCQELSVDNLVLNIETHHNFSLN PTIIDPLTRVIATTPLEIDSLIQEAQDHA NAALAKVEESDKYLRAVTGGNYSNW YIVLVIVLLFGNLGWSLLLTVLLCRSR KQQRRYQQDDSVGSERGVGVGTIQY MS | | |
| KX258200 | 4443-6068 | gb:KX258 200:4443-6068\|Organism:Avian paramyxovirus 14\|Strain Name:APMV14/duck/Japan/110G0352/2011\|Protein Name:fusion protein\|Gene Symbol:F | MEKGTVLFLAALTLYNVKALDNTKL LGAGIASGKEHELKIYQSSVNGYIAVK LIPFLPSTKRECYNEQLKNYNATINRL MGPINDNIKLVLSGVKTRTREGKLIGA IIGTAALGLATAAQVTAAIALEQAQD NARAILTLKESIRNTNNAVSELKTGLS EVSIALSKTQDYINTQIMPALSNLSCEI VGLKIGIQLSQYLTEVTAVFGNQITNP ALQPLSMQALYQLCGGDFSLLLDKIG ADRNELESLYEANLVTGRIVQYDTAD QLVIIQVSIPSVSTLSGYRVTELQSISV DMDHGEGKAVIPRYIVTSGRVIEEMDI SPCVLTATAVYCNRLLTTSLPESVLKC LDGDHSSCTYTSNSGVLETRYIAFDG MLIANCRSIVCKCLDPPYIIPQNKGKPL TIISKEVCKKVTLDGITLLIDAEFTGEY GLNITIGPDQFAPSGALDISTELGKLNN SINKAEDYIDKSNELLNRVNVDIVNDT AVIVLCVMSALVVVWCIGLTVGLIYV SKNTLRAVAIKGTSIENPYVSSGKHAK NSS | 1 | 680 |
| KY511044 | 4592-6247 | gb:KY511044:4592-6247\|Organism:Avian paramyxovirus UPO216\|Strain Name:APMV-15/WB/Kr/UPO216/2014\|Protein Name:fusion protein\|Gene Symbol:F | MIFTMYHVTVLLLLSLLTLPLGIQLAR ASIDGRQLAAAGIVVTGEKAINLYTSS QTGTIVVKLLPNVPQGREACMRDPLT SYNKTLTSLLSPLGEAIRRIHESTTETA GLVQARLVGAIIGSVALGVATSAQITA AAALIQANKNAENILKLKQSIAATNE AVHEVTDGLSQLAVAVGKMQDFINT QFNNTAQEIDCIRISQQLGVELNLYLT ELTTVFGPQITSPALSPLSIQALYNLAG GNLDVLLSKIGVGNNQLSALISSGLIS GSPILYDSQTQLLGIQVTLPSVSSLNN MRAIFLETLSVSTDKGFAAALIPKVVT TVGTVTEELDTSYCIETDIDLFCTRIVT FPMSPGIYACLNGNTSECMYSKTQGA LTTPYMSVKGSIVANCKMTTCRCADP ASIISQNYGEAVSLIDSSVCRVITLDGV TLRLSGSFDSTYQKNITIRDSQVIITGS LDISTELGNVNNSINNALDKIEESNQIL ESVNVSLTSTNALIVYIICTALALICGIT GLILSCYIMYKMRSQQKTLMWLGNN TLDQMRAQTKM | 1 | 681 |
| NC_025360 | 6104-8123 | gb:NC_025360:6104-8123\|Organism:Atlantic salmon paramyxovirus\|Strain Name:ASPV/ | MDGPKFRFVLLILLTAPARGQVDYDK LLKVGIFEKGTANLKISVSSQQRYMVI KMMPNLGPMNQCGIKEVNLYKESILR LITPISTTLNYIKSEIQVEREVALQPNG TIVRFFGLIVAAGALTLATSAQITAGIA LHNSLENAKAIKGLTDAIKESNLAIQK | 1 | 682 |

TABLE 4-continued

Paramyxovirus F sequence clusters. Column 1, Genbank ID includes the Genbank ID of the whole genome sequence of the virus that is the centroid sequence of the cluster. Column 2, Nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster provides the number of sequences that cluster with this centroid sequence.

| Genbank ID | Nucleotides of CDS | Full Gene Name | Sequence | #Sequences/ Cluster | SEQ ID NO |
|---|---|---|---|---|---|
| | | Yrkje371/95\| Protein Name:fusion protein\|Gene Symbol:F | IQDATAGTVIALNALQDQVNTNIIPAI NTLGCTAAGNTLGIALTRYYSELIMIF GPSLGNPVEAPLTIQALAGAFNGDLH GMIREYGYTPSDIEDILRTNSVTGRVI DVDLVGMNIVLEINLPTLYTLRDTKIV NLGKITYNVDGSEWQTLVPEWLAIRN TLMGGVDLSRCVVSSRDLICKQDPVF SLDTSIISCLNGNTESCPRNRVVNSVA PRYAVIRGNILANCISTTCLCGDPGVPI IQKGDNTLTAMSINDCKLVGVDGYVF RPGPKAVNVTFNLPHLNLGPEVNVNP VDISGALGKVEQDLASSRDHLAKSEKI LSGINPNIINTEMVLVAVILSLVCAMV VIGIVCWLSILTKWVRSCRADCRRPN KGPDLGPIMSSQDNLSF | | |
| UniProt ID: Q9IH63 | | FUS_NIP AV Fusion glycoprotein F0 OS = Nipah virus | MVVILDKRCYCNLLILILMISECSVGIL HYEKLSKIGLVKGVTRKYKIKSNPLT KDIVIKMIPNVSNMSQCTGSVMENYK TRLNGILTPIKGALEIYKNNTHDLVGD VRLAGVIMAGVAIGIATAAQITAGVA LYEAMKNADNINKLKSSIESTNEAVV KLQETAEKTVYVLTALQDYINTNLVP TIDKISCKQTELSLDLALSKYLSDLLFV FGPNLQDPVSNSMTIQAISQAFGGNYE TLLRTLGYATEDFDDLLESDSITGQIIY VDLSSYYIIVRVYFPILTEIQQAYIQEL LPVSFNNDNSEWISIVPNFILVRNTLIS NIEIGFCLITKRSVICNQDYATPMTNN MRECLTGSTEKCPRELVVSSHVPRFA LSNGVLFANCISVTCQCQTTGRAISQS GEQTLLMIDNTTCPTAVLGNVIISLGK YLGSVNYNSEGIAIGPPVFTDKVDISS QISSMNQSLQQSKDYIKEAQRLLDTV NPSLISMLSMIILYVLSIASLCIGLITFIS FIIVEKKRNTYSRLEDRRVRPTSSGDL YYIGT | 683 | |

In some embodiments, a fusogen described herein comprises an amino acid sequence of Table 5, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to any amino acid sequence of Table 5. In some embodiments, a nucleic acid sequence described herein encodes an amino acid sequence of Table 5, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

In some embodiments, a fusogen described herein comprises an amino acid sequence set forth in any one of SEQ ID NOS: 684-759, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 100, 200, 300, 400, 500, or 600 amino acids in length. For instance, in some embodiments, a fusogen described herein comprises an amino acid sequence having at least 80% identity to an amino acid sequence set forth in any one of SEQ ID NOS: 684-759. In some embodiments, a nucleic acid sequence described herein encodes an amino acid sequence set forth in any one of SEQ ID NOS: 684-759, or an amino acid sequence having at least 80%, 85%, 90%, 95%, 96%, 97%, 98%, or 99% sequence identity thereto, or an amino acid sequence having at least 80%, 85%, 90%, 95%, 96%, 97%, 98%, or 99% sequence identity to a portion of the sequence, e.g., a portion of 40, 50, 60, 80, 100, 200, 300, 400, 500, or 600 amino acids in length.

TABLE 5

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| KU950686 | 4643-5638 | gb:KU950686:4643-5638\|Organism:Human respiratory syncytial virus\|Strain Name:RSVA/*Homo sapiens*/USA/TH_10506/2014\|Protein Name:attachment glycoprotein\|Gene Symbol:G | MSKTKDQRTAKTLERTWDTLNHLLFISSC LYKLNLKSIAQITLSILAMIISTSLIIAAIIFIA SANHKVTLTTAIIQDATNQIKNTTPTYLTQ NPQLGISFSNLSGTTLQSTTILASTTPSAEST PQSTTVKIINTTTTQILPSKPTTKQRQNKPQ NKPNNDFHFEVFNFVPCSICSNNPTCWAIC KRIPNKKPGKKTTTKPTKKPTLKTTKKDP KPQTTKPKEALTTKPTGKPTINTTKTNIRTT LLTSNTKGNPEHTSQEETLHSTTSEGYLSP SQVYTTSGQEETLHSTTSEGYLSPSQVYTT SEYLSQSLSSSNTTK | 706 | 684 |
| AB524405 | 6424-8274 | gb:AB524405:6424-8274\|Organism:Newcastle disease virus\|Strain Name:Goose/Alaska/415/91\|Protein Name:hemagglutinin-neuraminidase protein\|Gene Symbol:HN | MERGVSQVALENDEREAKNTWRLVFRVT VLFLTIVTLAISAAALAFSMNASTPQDLEGI PVAISKVEDKITSALGASQDVMDRIYKQV ALESPLALLNTESTIMNALTSLSYQINGAA NASGCGAPVPDPDYIGGIGKELIVDDTSDV TSFYPSAFQEHLNFIPAPTTGSGCTRIPSFD MSATHYCYTHNVILSGCRDHSHSHQYLAL GVLRTSATGRVFFSTLRSINLDDTQNRKSC SVSATPLGCDMLCSKVTETEEEDYQSTDP TLMVHGRLGFDGQYHERDLDVHTLFGDW VANYPGVGGGSFINNRVWFPVYGGLKPGS PTDKRQEGQYAIYKRYNDTCPDDQEYQV RMAKSAYKPNRFGGKRVQQAILSIGVSTT LADDPVLTVTSNTITLMGAEGRVMTVGTS HYLYQRGSSYYSPAILYPLTIANKTATLQD PYKFNAFTRPGSVPCQASARCPNSCVTGV YTDPYPIVFHKNHTLRGVFGTMLDDEQAR LNPVSAVFDSIARSRVTRVSSSSTKAAYTT STCFKVVKTGKVYCLSIAEISNTLFGEFRIV PLLVEILRDEGRSEARSALTTQGHPGWND EVVDPIFCAVTNQTDHRQKLEEYAQSWP | 418 | 685 |
| JQ582844 | 4686-5636 | gb:JQ582844:4686-5636\|Organism:Human respiratory syncytial virus\|Strain Name:NH1067\|Protein Name:receptor-binding glycoprotein\|Gene Symbol:G | MSKNKNQRTARTLEKTWDTLNHLIVISSC LYKLNLKSIAQIALSVLAMIISTSLIIAAIIFII SANHKVTLTTVTVQTIKNHTEKNITTYLTQ VSPERVSPSKQPTTTPPIHTNSATISPNTKSE THHTTAQTKGRTTTPTQNNKPSTKPRPKN PPKKPKDDYHFEVFNFVPCSICGNNQLCKS ICKTIPNNKPKKKPTTKPTNKPPTKTTNKR DPKTPAKTLKKETTINPTTKKPTPKTTERD TSTPQSTVLDTTTSKHTERDTSTPQSTVLD TTTSKHTIQQQSLHSITPENTPNSTQTPTAS EPSTSNSTQKL | 278 | 686 |
| AB254456 | 7271-9136 | gb:AB254456:7271-9136\|Organism:Measles virus\|Strain Name:SSPE-Kobe-1\|Protein Name:Hemagglutinin\|Gene Symbol:H | MSPHRDRINAFYRDNPHPKGSRIVINREHL MIDRPYVLLAVLFVMFLSLIGLLAIAGIRL HRAAIYTAEIHKSLSTNLDVTNSIEHQVKD VLTPLFKIIGDEVGLRTPQRFTDLVKFISDK IKFLNPDREYDFRDLTWCINPPERIKLDYD QYCADVAAEELMNALVNSTLLEARATNQ FLAVSKGNCSGPTTIRGQFSNMSLSLLDLY LSRGYNVSSIVTMTSQGMYGGTYLVGKPN LSSKGSELSQLSMHRVFEVGVIRNPGLGAP VFHMTNYFEQPVSNDFSNCMVALGELRFA ALCHREDSVTVPYQGSGKGVSFQLVKLGV WKSPTDMQSWVPLSTDDPVIDRLYLSSHR GVIADNQAKWAVPTTRTDDKLRMETCFQ QACKGKNQALCENPEWAPLKDNRIPSYG VLSVNLSLTVELKIKIASGFGPLITHGSGM DLYKTNHDNVYWLTIPPMKNLALGVINTL EWIPRFKVSPNLFTVPIKEAGEDCHAPTYL PAEVDGDVKLSSNLVILPGQDLQYVLATY DTSRVEHAVVYYVYSPSRSFSYFYPFRLPI KGVPIELQVECFTWDQKLWCRHFCVLADS | 128 | 687 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | ESGGHITHSGMVGMGVSCTVTREDGTNR RQGCQ | | |
| AB040874 | 6614-8362 | gb:AB040874:6614-8362\| Organism:Mumps virus\|Strain Name:Miyahara\| Protein Name:hemagglutinin-neuraminidase\| Gene Symbol:HN | MEPSKLFTMSDNATFAPGPVINAADKKTF RTCFRILVLSVQAVTLILVIVTLGELVRMIN DQGLSNQLSSIADKIRESATMIASAVGVM NQVIHGVTVSLPLQIEGNQNQLLSTLATIC TGKKQVSNCSTNIPLVNDLRFINGINKFIIE DYATHDFSIGHPLNMPSFIPTATSPNGCTRI PSFSLGKTHWCYTHNVINANCKDHTSSNQ YISMGILVQTASGYPMFKTLKIQYLSDGLN RKSCSIATVPDGCAMYCYVSTQLETDDYA GSSPPTQKLTLLFYNDTVTERTISPTGLEGN WATLVPGVGSGIYFENKLIFPAYGGVLPNS SLGVKSAREFFRPVNPYNPCSGPQQDLDQ RALRSYFPSYFSNRRVQSAFLVCAWNQIL VTNCELVVPSNNQTLMGAEGRVLLINNRL LYYQRSTSWWPYELLYEISFTFTNSGQSSV NMSWIPIYSFTRPGSGNCSGENVCPTACVS GVYLDPWPLTPYSHQSGINRNFYFTGALL NSSTTRVNPTLYVSALNNLKVLAPYGNQG LFASYTTTTCFQDTGDASVYCVYIMELAS NIVGEFQILPVLTRLTIT | 87 | 688 |
| AB736166 | 6709-8427 | gb:AB736166:6709-8427\| Organism:Human respirovirus 3\|Strain Name:ZMLS/2011\| Protein Name:hemagglutinin-neuraminidase\| Gene Symbol:HN | MEYWKHTNHGKDAGNELETATATHGNR LTNKITYILWTITLVLLSIVFIIVLINSIKSEK AHESLLQDINNEFMEVTEKIQVASDNTND LIQSGVNTRLLTIQSHVQNYIPISLTQQISDL RKFISEITIRNDNQEVPPQRITHDVGIKPLNP DDFWRCTSGLPSLMRTPKIRLMPGPGLLA MPTTVDGCVRTPSLVINDLIYAYTSNLITR GCQDIGKSYQVLQIGIITVNSDLVPDLNPRI SHTFNINDNRKSCSLALLNTDVYQLCSTPK VDERSDYASSGIEDIVLDIVNYDGSISTTRF KNNNISFDQPYAALYPSVGPGIYYKGKIIFL GYGGLEHPINENAICNTTGCPGKTQRDCN QASHSPWFSDRRMVNSIIVVDKGLNSVPK LKVWTISMRQNYWGSEGRLLLLGNKIYIY TRSTSWHSKLQLGIIDITDYSDIRIKWTWH NVLSRPGNNECPWGHSCPDGCITGVYTDA YPLNPTGSIVSSVILDSQKSRVNPVITYSTA TERVNELAIRNKTLSAGYTTTSCITHYNKG YCFHIVEINHKSLNTFQPMLFKTEIPKSCS | 78 | 689 |
| KJ627396 | 6166-6885 | gb:KJ627396:6166-6885\| Organism:Human metapneumovirus\| Strain Name:HMPV/ *Homo sapiens*/PER/ FLI1305/2010/A\| Protein Name:attachment glycoprotein G\|Gene Symbol:G | MEVKVENIRAIDMLKARVKNRVARSKCF KNASLILIGITTLSIALNIYLIINYTIQKTTSE SEHHTSSPPTESNKETSTIPIDNPDITPNSQH PTQQSTESLTLYPASSMSPSETEPASTPGIT NRLSLADRSTTQPSESRTKTNSTVHKKNK KNISSTISRTQSPPRTTAKAVSRTTALRMSS TGERPTTTSVQSDSSTTAQNHEETGPANPQ ASVSTM | 71 | 690 |
| AB475097 | 7079-8902 | gb:AB475097:7079-8902\| Organism:Canine distemper virus\|Strain Name:M25CR\| Protein Name:hemagglutinin\| Gene Symbol:H | MLSYQDKVGAFYKDNARANSSKLSLVTE EQGGRRPPYLLFVLLILLVGILALLAIAGVR FRQVSTSNVEFGRLLKDDLEKSEAVHHQV MDVLTPLFKIIGDEIGLRLPQKLNEIKQFIL QKTNFFNPNREFDFRDLHWCINPPSKIKVN FTNYCDAIGVRKSIASAANPILLSALSGGR GDIFPPYRCSGATTSVGRVFPLSVSLSMSLI SKTSEIISMLTAISDGVYGKTYLLVPDYIER EFDTQKIRVFEIGFIKRWLNDMPLLQTTNY MVLPENSKAKVCTIAVGELTLASLCVDES | 45 | 691 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | TVLLYHDSNGSQDSILVVTLGIFGATPMNQ<br>VEEVIPVAHPSVERIHITNHRGFIKDSVAT<br>WMVPALVSEQQEGQKNCLESACQRKSYP<br>MCNQTSWEPFGGVQLPSYGRLTLPLDASI<br>DLQLNISFTYGPVILNGDGMDYYENPLLDS<br>GWLTIPPKNGTILGLINKASRGDQFTVTPH<br>VLTFAPRESSGNCYLPIQTSQIMDKDVLTE<br>SNLVVLPTQNFRYVVATYDISRENHAIVY<br>YVYDPIRTISYTYPFRLTTKGRPDFLRIECF<br>VWDDDLWCHQFYRFESDITNSTTSVEDLV<br>RIRFSCNRSKP | | |
| AJ849636 | 7326-9155 | gb:AJ849636:7326-9155\|<br>Organism:Peste-des-<br>petits-<br>ruminants<br>virus\|Strain<br>Name:Turkey<br>2000\|Protein<br>Name:haemagglutinin\|<br>Gene<br>Symbol:H | MSAQRERINAFYKDNPHNKNHRVILDRER<br>LVIERPYILLGVLLVMFLSLIGLLAIAGIRL<br>HRATVGTSEIQSRLNTNIELTESIDHQTKD<br>VLTPLFKIIGDEVGIRIPQKFSDLVKFISDKI<br>KFLNPDREYDFRDLRWCMNPPERVKINFD<br>QFCEYKAAVKSIEHIFESPLNKSKKLQSLT<br>LGPGTGCLGRTVTRAHFSELTLTLMDLDL<br>EMKHNVSSVFTVVEEGLFGRTYTVWRSD<br>ARDPSTDLGIGHFLRVFEIGLVRDLGLGPP<br>VFHMTNYLTVNMSDDYRRCLLAVGELKL<br>TALCSSSETVTLGERGVPKREPLVVVILNL<br>AGPTLGGELYSVLPTSDLMVEKLYLSSHR<br>GIIKDDEANWVVPSTDVRDLQNKGECLVE<br>ACKTRPPSFCNGTGSGPWSEGRIPAYGVIR<br>VSLDLASDPGVVITSVFGPLIPHLSGMDLY<br>NNPFSRAVWLAVPPYEQSFLGMINTIGFPN<br>RAEVMPHILTTEIRGPRGRCHVPIELSRRV<br>DDDIKIGSNMVILPTIDLRYITATYDVSRSE<br>HAIVYYIYDTGRSSSYFYPVRLNFKGNPLS<br>LRIECFPWRHKVWCYHDCLIYNTITDEEV<br>HTRGLTGIEVTCNPV | 34 | 692 |
| AB005795 | 6693-8420 | gb:AB005795:6693-8420\|<br>Organism:Sendai<br>virus\|Strain<br>Name:Ohita\|<br>Protein<br>Name:hemagglutinin-<br>neuraminidase<br>protein\|Gene<br>Symbol:HN | MDGDRSKRDSYWSTSPGGSTTKLVSDSER<br>SGKVDTWLLILAFTQWALSIATVIICIVIAA<br>RQGYSMERYSMTVEALNTSNKEVKESLTS<br>LIRQEVITRAANIQSSVQTGIPVLLNKNSRD<br>VIRLIEKSCNRQELTQLCDSTIAVHHAEGIA<br>PLEPHSFWRCPAGEPYLSSDPEVSLLPGPSL<br>LSGSTTISGCVRLPSLSIGEAIYAYSSNLITQ<br>GCADIGKSYQVLQLGYISLNSDMFPDLNP<br>VVSHTYDINDNRKSCSVVATGTRGYQLCS<br>MPIVDERTDYSSDGIEDLVLDILDLKGRTK<br>SHRYSNSEIDLDHPFSALYPSVGSGIATEGS<br>LIFLGYGGLTTPLQGDTKCRIQGCQQVSQD<br>TCNEALKITWLGGKQVVSVLIQVNDYLSE<br>RPRIRVTTIPITQNYLGAEGRLLKLGDQVYI<br>YTRSSGWHSQLQIGVLDVSHPLTISWTPHE<br>ALSRPGNEDCNWYNTCPKECISGVYTDAY<br>PLSPDAANVATVTLYANTSRVNPTIMYSN<br>TTNIINMLRIKDVQLEAAYTTTSCITHFGK<br>GYCFHIIEINQKSLNTLQPMLFKTSIPKLCK<br>AES | 23 | 693 |
| AF457102 | 6903-8630 | gb:AF457102\|<br>Organism:Human<br>parainfluenza<br>virus 1 strain<br>Washington/1964\|<br>Strain<br>Name:Washington<br>1964\|Protein<br>Name:HN<br>glycoprotein\|<br>Gene<br>Symbol:HN | MAEKGKTNSSYWSTTRNDNSTVNTHINTP<br>AGRTHIWLLIATTMHTVLSFIIMILCIDLIIK<br>QDTCMKTNIMTVSSMNESAKIIKETITELIR<br>QEVISRTINIQSSVQSGIPILLNKQSRDLTQL<br>IEKSCNRQELAQICENTIAIHHADGISPLDP<br>HDFWRCPVGEPLLSNNPNISLLPGPSLLSG<br>STTISGCVRLPSLSIGDAIYAYSSNLITQGC<br>ADIGKSYQVLQLGYISLNSDMYPDLNPVIS<br>HTYDINDNRKSCSVIAAGTRGYQLCSLPTV<br>NETTDYSSEGIEDLVFDILDLKGKTKSHRY<br>KNEDITFDHPFSAMYPSVGSGIKIENTLIFL<br>GYGGLTTPLQGDTKCVINRCTNVNQSVCN<br>DALKITWLKKRQVVNVLIRINNYLSDRPKI | 21 | 694 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | VVETIPITQNYLGAEGRLLKLGKKIYIYTRS SGWHSNLQIGSLDINNPMTIKWAPHEVLS RPGNQDCNWYNRCPRECISGVYTDAYPLS PDAVNVATTTLYANTSRVNPTIMYSNTSEI INMLRLKNVQLEAAYTTTSCITHFGKGYC FHIVEINQASLNTLQPMLFKTSIPKICKITS | | |
| KJ627397 | 6146-6888 | gb:KJ627397:6146-6888\|Organism:Human metapneumovirus\|Strain Name:HMPV/*Homo sapiens*/PER/FPP00098/2010/B\|Protein Name:attachment glycoprotein G\|Gene Symbol:G | MEVRVENIRAIDMFKAKMKNRIRSSKCYR NATLILIGLTALSMALNIFLIIDYATLKNMT KVEHCVNMPPVEPSKKSPMTSAADLNTKL NPQQATQLTTEDSTSLAATSENHLHTETTP TSDATISQQATDEHTTLLRPINRQTTQTTE KKPTGATTKKDKEKETTTRTTSTAATQTL NTTNQTSNGREATTTSARSRNGATTQNSD QTIQAADPSSKPYHTQTNTTTAHNTDTSSL SS | 21 | 695 |
| AF017149 | 8913-10727 | gb:AF0171491 Organism:Hendra virus\|Strain Name:UNKNOWN-AF017149\|Protein Name:glycoprotein\|Gene Symbol:G | MMADSKLVSLNNNLSGKIKDQGKVIKNY YGTMDIKKINDGLLDSKILGAFNTVIALLG SIIIIVMNIMIIQNYTRTTDNQALIKESLQSV QQQIKALTDKIGTEIGPKVSLIDTSSTITIPA NIGLLGSKISQSTSSINENVNDKCKFTLPPL KIHECNISCPNLPFREYRPISQGVSDLVGL PNQICLQKTTSTILKPRLISYTLPINTREGVC ITDPLLAVDNGFFAYSHLEKIGSCTRGIAK QRIIGVGEVLDRGDKVPSMFMTNVWTPPN PSTIHHCSSTYHEDFYYTLCAVSHVGDPIL NSTSWTESLSLIRLAVRPKSDSGDYNQKYI AITKVERGKYDKVMPYGPSGIKQGDTLYF PAVGFLPRTEFQYNDSNCPIIHCKYSKAEN CRLSMGVNSKSHYILRSGLLKYNLSLGGDI ILQFIEIADNRLTIGSPSKIYNSLGQPVFYQA SYSWDTMIKLGDVDTVDPLRVQWRNNSV ISRPGQSQCPRFNVCPEVCWEGTYNDAFLI DRLNWVSAGVYLNSNQTAENPVFAVFKD NEILYQVPLAEDDTNAQKTITDCFLLENVI WCISLVEIYDTGDSVIRPKLFAVKIPAQCSE S | 14 | 696 |
| AF212302 | 8943-10751 | gb:AF212302\|Organism:Nipah virus\|Strain Name:UNKNOWN-AF212302\|Protein Name:attachment glycoprotein\|Gene Symbol:G | MPAENKKVRFENTTSDKGKIPSKVIKSYY GTMDIKKINEGLLDSKILSAFNTVIALLGSI VIIVMNIMIIQNYTRSTDNQAVIKDALQGIQ QQIKGLADKIGTEIGPKVSLIDTSSTITIPAN IGLLGSKISQSTASINENVNEKCKFTLPPLKI HECNISCPNLPFREYRPQTEGVSNLVGLP NNICLQKTSNQILKPKLISYTLPVVGQSGT CITDPLLAMDEGYFAYSHLERIGSCSRGVS KQRIIGVGEVLDRGDEVPSLFMTNVWTPP NPNTVYHCSAVYNNEFYYVLCAVSTVGD PILNSTYWSGSLMMTRLAVKPKSNGGGY NQHQLALRSIEKGRYDKVMPYGPSGIKQG DTLYFPAVGFLVRTEFKYNDSNCPITKCQY SKPENCRLSMGIRPNSHYILRSGLLKYNLS DGENPKVVFIEISDQRLSIGSPSKIYDSLGQ PVFYQASFSWDTMIKFGDVLTVNPLVVN WRNNTVISRPGQSQCPRFNTCPEICWEGV YNDAFLIDRINWISAGVFLDSNQTAENPVF TVFKDNEILYRAQLASEDTNAQKTITNCFL LKNKIWCISLVEIYDTGDNVIRPKLFAVKIP EQCT | 14 | 697 |
| EU439428 | 6751-8638 | gb:EU439428:6751-8638\|Organism:Swine parainfluenza | MEYWKHTNSTKDTNNELGTTRDRHSSKA TNIIMYIFWTTTSTILSVIFIMILINLIQENNH NKLMLQEIKKEFAVIDTKIQKTSDDISTSIQ | 14 | 698 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | virus 3\|Strain Name:92-7783_ISU-92\|Protein Name:hemagglutinin-neuraminidase HN\|Gene Symbol:HN | SGINTRLLTIQSHVQNYIPLSLTQQMSDLR KFINDLTTKREHQEVPIQRMTHDSGIEPLN PDKFWRCTSGNPSLTSSPKIRLIPGPGLLAT STTVNGCIRIPSLAINNLIYAYTSNLITQGC QDIGKSYQVLQIGIITINSDLVPDLNPRVTH TFNIDDNRKSCSLALLNTDVYQLCSTPKV DERSDYASTGIEDIVLDIVTSNGLIITTRFTN NNITFDKPYAALYPSVGPGIYYKDKVIFLG YGGLEHEENGDVICNTTGCPGKTQRDCNQ ASYSPWFSNRRMVNSIIVVDKSIDTTFSLR VWTIPMRQNYWGSEGRLLLLGDRIYIYTR STSWHSKLQLGVIDISDYNNIRINWTWHN VLSRPGNDECPWGHSCPDGCITGVYTDAY PLNPSGSVVSSVILDSQKSRENPIITYSTAT NRVNELAIYNRTLPAAYTTTNCITHYDKG YCFHIVEINHRSLNTFQPMLFKTEVPKNCS | | |
| KF530164 | 6157-6906 | gb:KF530164:6157-6906\| Organism:Human metapneumovirus\| Strain Name:HMPV/ AUS/172832788/ 2004/B\|Protein Name:attachment glycoprotein G\|Gene Symbol:G | MEVRVENIRAIDMFKAKIKNRIRSSRCYRN ATLILIGLTALSMALNIFLIIDHATLRNMIK TENCANMPSAEPSKKTPMTSTAGPSTKPN PQQATQWTTENSTSPAATLEGHPYTGTTQ TPDTTAPQQTTDKHTALPKSTNEQITQTTT EKKTTRATTQKREKRKENTNQTTSTAATQ TTNTTNQTRNASETITTSDGPRIDTTTQSSE QTARATEPGSSPYHARRGAGPR | 14 | 699 |
| AB910309 | 6960-8747 | gb:AB910309:6960-8747\| Organism:Feline morbillivirus\| Strain Name:SS1\|Protein Name:hemagglutinin protein\|Gene Symbol:H | MKNINIKYYKDSNRYLGKILDEHKIVNSQL YSLSIKVITIIAIIVSLIATIMTIINATSGRTTL NSNTDILLNQRDEIHSIHEMIFDRVYPLITA MSTELGLHIPTLLDELTKAIDQKIKIMNPPV DTVTSDLSWCIKPPNGIIIDPKGYCESMELS KTYKLLLDQLDVSRKKSLTINRKNINQCQ LVDDSEIIFATVNIQSTPRFLNFGHTVSNQR ITFGQGTYSSTYILTIQEDGITDVQYRVFEI GYISDQFGVFPSLIVSRVLPIRMVLGMESC TLTSDRQGGYFLCMNTLTRSIYDYVNIRDL KSLYITLPHYGKVNYTYFNFGKIRSPHEID KLWLTSDRGQIISGYFAAFVTITIRNYNNY PYKCLNNPCFDNSENYCRGWYKNITGTDD VPILAYLLVEMYDEEGPLITLVAIPPYNYT APSHNSLYYDDKINKLIMTTSHIGYIQINEV HEVIVGDNLKAILLNRLSDEHPNLTACRLN QGIKEQYKSDGMIISNSALIDIQERMYITVK AIPPVGNYNFTVELHSRSNTSYILLPKQFN AKYDKLHLECFNWDKSWWCALIPQFSLS WNESLSVDTAIFNLINCK | 12 | 700 |
| AB759118 | 7116-8957 | gb:AB759118:7116-8957\| Organism:Avian paramyxovirus 6\|Strain Name:red-necked stint/Japan/ 8KS0813/2008\| Protein Name:hemagglutinin-neuraminidase\| Gene Symbol:HN | MASPSELNRSQATLYEGDPNSKRTWRTVY RASTLILDLAILCVSIVAIVRMSTLTPSDVT DSISSSITSLSDTYQSVWSDTHQKVNSIFKE VGISIPVTLDKMQVEMGTAVNIITDAVRQL QGVNGSAGFSITNSPEYSGGIDALIYPQKSL NGKSLAISDLLEHPSFIPAPTTSHGCTRIPTF HLGYRHWCYSHNTIESGCHDAGESIMYLS MGAVGVGHQGKPVFTTSAAVILDDGKNR KSCSVVANPNGCDVLCSLVKQTEDQDYA DPTPTPMIHGRLHFNGTYTESMLDQSLFTG HWVAQYPAVGSGSVSHGRLFFPLYGGISK SSSLFPKLRAHAYFTHNEELECKNLTSKQR EDLFNAYMPGKIAGSLWAQGIVICNLTTL ADCKIAVANTSTMMMAAEGRLQLVQDK VVLYQRSSSWWPVLIYYDILVSELVNARH LDIVNWVPYPQSKFPRPTWTKGLCEKPSIC PAVCVTGVYQDVWVVSVGDFSNETVVIG GYLEAASERKDPWIAAANQYNWLTRRQL | 11 | 701 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | FTAQTEAAYSSTTCFRNTHQDKVFCLTIME VTDNLLGDWRIAPLLYEVTVVDRQQSSRK AVAMSEAHRTRFKYYSPENKFTPQH | | |
| AY141760 | 6791-8485 | gb:AY141760\|Organism:Fer-de-Lance paramyxovirus\|Strain Name:ATCC VR-895\|Protein Name:hemagglutinin-neuraminidase protein HN\|Gene Symbol:HN | MDPKSYYCNEDLRSDGGEKSPGGDLYKGI ILVSTVISLIIAIISLAFIIDNKINIQSLDPLRG LEDSYLVPIKDKSESISQDIQEGIFPRLNLIT AATTTTIPRSIAIQTKDLSDLIMNRCYPSVV NNDTSCDVLAGAIHSNLFSQLDPSTYWTC SSGTPTMNQTVKLLPDNSQIPGSTYSTGCV RIPTFSLGSMIYSYSHNVIYEGCNDHSKSSQ YWQLGYISTSKTGEPLQQVSRTLTLNNGL NRKSCSTVAQGRGAYLLCTNVVEDERTD YSTEGIQDLTLDYIDIFGAERSYRYTNNEV DLDRPYAALYPSVGSGTVYNDRILFLGYG GLMTPYGDQAMCQAPECTSATQEGCNSN QLIGYFSGRQIVNCIIEIITVGTEKPIIRVRTI PNSQVWLGAEGRIQTLGGVLYLYIRSSGW HALAQTGIILTLDPIRISWIVNTGYSRPGNG PCSASSRCPAQCITGVYTDIFPLSQNYGYL ATVTLLSGVDRVNPVISYGTSTGRVADSQ LTSSSQVAAYTTTTCFTFNQKGYCYHIIEL SPATLGIFQPVLVVTEIPKICS | 8 | 702 |
| EU877976 | 6248-8161 | gb:EU877976:6248-8161\|Organism:Avian paramyxovirus 4\|Strain Name:APMV-4/KR/YJ/06\|Protein Name:hemagglutinin-neuraminidase\|Gene Symbol:HN | MQGNMEGSRDNLTVDDELKTTWRLAYR VVSLLLMVSALIISIVILTRDNSQSIITAINQS SDADSKWQTGIEGKITSIMTDTLDTRNAAL LHIPLQLNTLEANLLSALGGNTGIGPGDLE HCRYPVHDTAYLHGVNRLLINQTADYTAE GPLDHVNFIPAPVTTTGCTRIPSFSVSSSIW CYTHNVIETGCNDHSGSNQYISMGVIKRA GNGLPYFSTVVSKYLTDGLNRKSCSVAAG SGHCYLLCSLVSEPEPDDYVSPDPTPMRLG VLTWDGSYTEQAVPERIFKNIWSANYPGV GSGAIVGNKVLFPFYGGVRNGSTPEVMNR GRYYYIQDPNDYCPDPLQDQILRAEQSYY PTRFGRRMVMQGVLACPVSNNSTIASQCQ SYYFNNSLGFIGAESRIYYLNGNIYLYQRS SSWWPHPQIYLLDSRIASPGTQNIDSGVNL KMLNVTVITRPSSGFCNSQSRCPNDCLFGV YSDIWPLSLTSDSIFAFTMYLQGKTTRIDPA WALFSNHAIGHEARLFNKEVSAAYSTTTC FSDTIQNQVYCLSILEVRSELLGAFKIVPFL YRVL | 8 | 703 |
| AB176531 | 6821-8536 | gb:AB176531:6821-8536\|Organism:Human parainfluenza virus 2\|Strain Name:Nishio\|Protein Name:hemagglutinin-neuraminidase protein\|Gene Symbol:HN | MEDYSNLSLKSIPKRTCRIIFRTATILGICTL IVLCSSILHEIIHLDVSSGLMDSDDSQQGIIQ PIIESLKSLIALANQILYNVAIIIPLKIDSIETV IFSALKDMHTGSMSNTNCTPGNLLLHDAA YINGINKFLVLKSYNGTPKYGPLLNIPSFIP SATSPNGCTRIPSFSLIKTHWCYTHNVMLG DCLDFTTSNQYLAMGIIQQSAAAFPIFRTM KTIYLSDGINRKSCSVTAIPGGCVLYCYVA TRSEKEDYATTDLAELRLAFYYYNDTFIER VISLPNTTGQWATINPAVGSGIYHLGFILFP VYGGLISGTPSYNKQSSRYFIPKHPNITCAG NSSEQAAAARSSYVIRYHSNRLIQSAVLIC PLSDMHTARCNLVMFNNSQVMMGAEGR LYVIDNNLYYYQRSSSWWSASLFYRINTD FSKGIPPIIEAQWVPSYQVPRPGVMPCNAT SFCPANCITGVYADVWPLNDPEPTSQNAL NPNYRFAGAFLRNESNRTNPTFYTASASA LLNTTGFNNTNHKAAYTSSTCFKNTGTQK IYCLIIIEMGSSLLGEFQIIPFLRELIP | 7 | 704 |
| AF052755 | 6584-8281 | gb:AF0527551 Organism:Parainfluenza virus | MVAEDAPVRATCRVLFRTTTLIFLCTLLAL SISILYESLITQKQIMSQAGSTGSNSGLGSIT DLLNNILSVANQIIYNSAVALPLQLDTLEST | 7 | 705 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | 5\|Strain Name:W3A\| Protein Name:hemagglutinin-neuraminidase protein\|Gene Symbol:HN | LLTAIKSLQTSDKLEQNCSWSAALINDNRY INGINQFYFSIAEGRNLTLGPLLNMPSFIPT ATTPEGCTRIPSFSLTKTHWCYTHNVILNG CQDHVSSNQFVSMGIIEPTSAGFPFFRTLKT LYLSDGVNRKSCSISTVPGGCMMYCFVST QPERDDYFSAAPPEQRIIIMYYNDTIVERII NPPGVLDVWATLNPGTGSGVYYLGWVLF PIYGGVIKGTSLWNNQANKYFIPQMVAAL CSQNQATQVQNAKSSYYSSWFGNRMIQS GILACPLRQDLTNECLVLPFSNDQVLMGA EGRLYMYGDSVYYYQRSNSWWPMTMLY KVTITFTNGQPSAISAQNVPTQQVPRPGTG DCSATNRCPGFCLTGVYADAWLLTNPSST STFGSEATFTGSYLNTATQRINPTMYIANN TQIISSQQFGSSGQEAAYGHTTCFRDTGSV MVYCIYIIELSSSLLGQFQIVPFIRQVTLS | | |
| BK005918 | 6560-8290 | gb:BK005918\| Organism:Porcine rubulavirus\|Strain Name:UNKNOWN-BK005918\|Protein Name:attachment protein\|Gene Symbol:HN | MSQLGTDQIMHLAQPAIARRTWRLCFRIF ALFILIAIVITQIFMLTFDHTLLTTTQFLTSIG NLQSTITSWTPDVQAMLSISNQLIYTTSITL PLKISTTEMSILTAIRDHCHCPDCSSACPTR QMLLNDPRYMSGVNQFIGAPTESINITFGP LFGIPSFIPTSTTTQGCTRIPSFALGPSHWCY THNFITAGCADGGHSNQYLAMGTIQSASD GSPLLITARSYYLSDGVNRKSCSIAVVPGG CAMYCYVATRSETDYYAGNSPPQQLLTL VFSNDTIIERTIHPTGLANGWVMLVPGVGS GTLYNEYLLFPAYGGMQQILANQSGEINQ FPTPYNATVRCAMAQPQFSQRAAASYYPR YFSNRWIRSAIVACPYRAIYQTQCTLIPLPN RMVMMGSEGRIFTLGDRLFYYQRSSSWW PYPLLYQVGLNFLTTPPSVSSMTQVPLEHL ARPGKGGCPGNSHCPATCVTGVYADVWP LTDPRSGVGGTSLVAAGGLDSTSERMAPV NYLAIGESLLSKTYLLSKTQPAAYTTTTCF RDTDTGKIYCITIAELGKVLLGEFQIVPFLR EIKIQSRY | 7 | 706 |
| EU338414 | 6015-7913 | gb:EU338414:6015-7913\| Organism:Avian paramyxovirus 2\|Strain Name:APMV-2/Chicken/California/Yucaipa/56\|Protein Name:hemagglutinin-neuraminidase\| Gene Symbol:HN | MDFPSRENLAAGDISGRKTWRLLFRILTLS IGVVCLAINIATIAKLDHLDNMASNTWTTT EADRVISSITTPLKVPVNQINDMFRIVALDL PLQMTSLQKEITSQVGFLAESINNVLSKNG SAGLVLVNDPEYAGGIAVSLYQGDASAGL NFQPISLIEHPSFVPGPTTAKGCIRIPTFHMG PSHWCYSHNIIASGCQDASHSSMYISLGVL KASQTGSPIFLTTASHLVDDNINRKSCSIVA SKYGCDILCSIVIETENEDYRSDPATSMIIG RLFFNGSYTESKINTGSIFSLFSANYPAVGS GIVVGDEAAFPIYGGVKQNTWLFNQLKDF GYFTHNDVYKCNRTDIQQTILDAYRPPKIS GRLWVQGILLCPVSLRPDPGCRLKVFNTS NVMMGAEARLIQVGSTVYLYQRSSSWWV VGLTYKLDVSEITSQTGNTLNHVDPIAHTK FPRPSFRRDACARPNICPAVCVSGVYQDIW PISTATNNSNIVWVGQYLEAFYSRKDPRIG IATQYEWKVTNQLFNSNTEGGYSTTTCFR NTKRDKAYCVVISEYADGVFGSYRIVPQLI EIRTTTGKSE | 7 | 707 |
| KC403973 | 6234-6964 | gb:KC403973:6234-6964\| Organism:Human metapneumovirus\| Strain Name:HMPV/USA/TN-82-518/1982/A\|Protein Name:attachment glycoprotein | MEVKVENIRTIDMLKARVKNRVARSKCFK NASLILIGITTLSIALNIYLIINYTMQENTSES EHHTSSSPMESSRETPTVPIDNSDTNPSSQY PTQQSTEGSTLYFAASASSPETEPTSTPDTT SRPPFVDTHTTPPSASRTKTSPAVHTKNNP RISSRTHSPPWAMTRTVRRTTTLRTSSIRK RSSTASVQPDSSATTHKHEEASPVSPQTSA STTRPQRKSMEASTSTTYNQTS | 6 | 708 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | G\|Gene Symbol:G\|Segment:8 | | | |
| KF015281 | 4511-5844 | gb:KF015281:4511-5844\| Organism:Canine pneumovirus\|Strain Name:dog/Bari/100-12/ITA/2012\| Protein Name:attachment protein\|Gene Symbol:G | MRPAEQLIQENYKLTSLSMGRNFEVSGST TNLNFERTQYPDTFRAVVKVNQMCKLIAG VLTSAAVAVCVGVIMYSVFTSNHKANSM QNATIRNSTSAPPQPTAGPPTTEQGTTPKFT KPPTKTTTHHEITEPAKMVTPSEDPYQCSS NGYLDRPDLPEDFKLVLDVICKPPGPEHHS TNCYEKREINLGSVCPDLVTMKANMGLN NGGGEEAAPYIEVITLSTYSNKRAMCVHN GCDQGFCFFLSGLSTDQKRAVLELGGQQA IMELHYDSYWKHYWSNSNCVVPRTNCNL TDQTVILFPSFNNKNQSQCTTCADSAGLD NKFYLTCDGLSRNLPLVGLPSLSPQAHKA ALKQSTGTTTAPTPETRNPTPAPRRSKPLS RKKRALCGVDSSREPKPTMPYWCPMLQL FPRRSNS | 6 | 709 |
| KF973339 | 4624-5310 | gb:KF973339:4624-5310\| Organism:Respiratory syncytial virus type A\|Strain Name:RSV-A/US/BID-V7358/2002\| Protein Name:truncated attachment glycoprotein\| Gene Symbol:G | MSKTKDQRAAKTLEKTWDTLNHLLFISSC LYKSNLKSIAQITLSILAMTIPTSLIIVATTFI ASANNKVTPTTAIIQDATSQIKNTTPTHLT QNPQPGISFFNLSGTISQTTAILAPTTPSVEP ILQSTTVKTKNTTTTQIQPSKLTTKQRQNK PPNKPNDDFHFEVFNFVPCSICSNNPTCWA ICKRIPSKKPGKKTTTKPTKKQTIKTTKKD LKPQTTKPKEAPTT | 6 | 710 |
| FJ215864 | 6383-8116 | gb:FJ215864:6383-8116\| Organism:Avian paramyxovirus 8\|Strain Name:pintail/ Walcuya/20/78\| Protein Name:hemagglutinin-neuraminidase protein\|Gene Symbol:HN | MSNIASSLENIVEQDSRKTTWRAIFRWSVL LITTGCLALSIVSIVQIGNLKIPSVGDLADE VVTPLKTTLSDTLRNPINQINDIFRIVALDIP LQVTSIQKDLASQFSMLIDSLNAIKLGNGT NLIIPTSDKEYAGGIGNPVFTVDAGGSIGFK QFSLIEHPSFIAGPTTTRGCTRIPTFHMSESH WCYSHNIIAAGCQDASASSMYISMGVLHV SSSGTPIFLTTASELIDDGVNRKSCSIVATQ FGCDILCSIVIEKEGDDYWSDTPTPMRHGR FSFNGSFVETELPVSSMFSSFSANYPAVGS GEIVKDRILFPIYGGIKQTSPEFTELVKYGL FVSTPTTVCQSSWTYDQVKAAYRPDYISG RFWAQVILSCALDAVDLSSCIVKIMNSSTV MMAAEGRIIKIGIDYFYYQRSSSWWPLAF VTKLDPQELADTNSIWLTNSIPIPQSKFPRP SYSENYCTKPAVCPATCVTGVYSDIWPLT SSSSLPSIIWIGQYLDAPVGRTYPRFGIANQ SHWYLQEDILPTSTASAYSTTTCFKNTARN RVFCVTIAEFADGLFGEYRITPQLYELVRN N | 5 | 711 |
| JX857409 | 6619-8542 | gb:JX857409:6619-8542\| Organism:Porcine parainfluenza virus 1\|Strain Name:S206N\| Protein Name:haemagglutinin protein\|Gene Symbol:H | MEETKVKTSEYWARSPQIHATNHPNVQN REKIKEILTILISFISSLSLVLVIAVLIMQSLH NGTILRCKDVGLESINKSTYSISNAILDVIK QELITRIINTQSSVQVALPILINKKIQDLSLII EKSSKVHQNSPTCSGVAALTHVEGIKPLDP DDYWRCPSGEPYLEDELTLSLIPGPSMLAG TSTIDGCVRLPSLAIGKSLYAYSSNLITKGC QDIGKSYQVLQLGIITLNSDLHPDLNPIISH TYDINDNRKSCSVAVSETKGYQLCSMPRV NEKTDYTSDGIEDIVFDVLDLKGSSRSFKF SNNDINFDHPFSALYPSVGSGIIWKNELYF LGYGALTTALQGNTKCNLMGCPGATQDN CNKFISSSWLYSKQMVNVLIQVKGYLSSK PSIIVRTIPITENYVGAEGKLVGTRERIYIYT RSTGWHTNLQIGVLNINHPITITWTDHRVL | 5 | 712 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | SRPGRSPCAWNNKCPRNCTTGVYTDAYPI SPDANYVATVTLLSNSTRNNPTIMYSSSDR VYNMLRLRNTELEAAYTTTSCIVHFDRGY CFHIIEINQKELNTLQPMLFKTAIPKACRIS NL | | |
| KF908238 | 7510-9249 | gb:KF908238:7510-9249\|Organism:Human parainfluenza virus 4b\|Strain Name:QLD-01\|Protein Name:hemagglutinin-neuraminidase protein\|Gene Symbol:HN | MQDSRGNTQIFSQANSMVKRTWRLLFRIV TLILLISIFVLSLIIVLQSTPGNLQSDVDIIRK ELDELMENFETTSKSLLSVANQITYDVSVL TPIRQEATETNIIAKIKDHCKDRVVKGEST CTLGHKPLHDVSFLNGFNKFYFTYRDNVQ IRLNPLLDYPNFIPTATTPHGCIRIPSFSLSQ THWCYTHNTILRGCEDTASSKQYVSLGTL QTLENGDPYFKVEYSHYLNDRKNRKSCSV VAVLDGCLLYCVIMTKNETENFKDPQLAT QLLTYISYNGTIKERIINPPGSSRDWVHISP GVGSGILYSNYIIFPLYGGLMENSMIYNNQ SGKYFFPNSTKLPCSNKTSEKITGAKDSYTI TYFSKRLIQSAFLICDLRQFLSEDCEILIPSN DHMLVGAEGRLYNIENNIFYYQRGSSWW PYPSLYRIKLNSNKKYPRIIEIKFTKIEIAPRP GNKDCPGNKACPKECITGVYQDIWPLSYP NTAFPHKKRAYYTGFYLNNSLARRNPTFY TADNLDYHQQERLGKFNLTAGYSTTTCFK QTTTARLYCLYILEVGDSVIGDFQIFPFLRS IDQAIT | 5 | 713 |
| KT071757 | 6066-7962 | gb:KT071757:6066-7962\|Organism:Avian paramyxovirus 2\|Strain Name:APMV-2/Emberiza spodocephala/China/Daxing'anling/974/2013\|Protein Name:hemagglutinin-neuraminidase protein\|Gene Symbol:HN | MDALSRENLTEISQGGRRTWRMLFRILTL VLTLVCLAINIATIAKLDSIDTSKVQTWTTT ESDRVIGSLTDTLKIPINQVNDMFRIVALDL PLQMTTLQKEIASQVGFLAESINNFLSKNG SAGSVLVNDPEYAGGIGTSLFHGDSASGL DFEAPSLIEHPSFIPGPTTAKGCIRIPTFHMS ASHWCYSHNIIASGCQDAGHSSMYISMGV LKATQAGSPSFLTTASQLVDDKLNRKSCSI ISTTYGCDILCSLVVENEDADYRSDPPTDM ILGRLFFNGTYSESKLNTSAIFQLFSANYPA VGSGIVLGDEIAFPVYGGVKQNTWLFNQL KDYGYFAHNNVYKCNNSNIHQTVLNAYR PPKISGRLWSQVVLICPMRLFINTDCRIKVF NTSTVMMGAEARLIQVGSDIYLYQRSSSW WVVGLTYKLDFQELSSKTGNILNNVSPIA HAKFPRPSYSRDACARPNICPAVCVSGVY QDIWPISTAHNLSQVVWVGQYLEAFYARK DPWIGIATQYDWKKNVRLFNANTEGGYS TTTCFRNTKRDKAFCVIISEYADGVFGSYR IVPQLIEIRTTSKKGLPS | 5 | 714 |
| LC041132 | 6605-8437 | gb:LC041132:6605-8437\|Organism:Avian paramyxovirus goose/Shimane/67/2000\|Strain Name:goose/Shimane/67/2000\|Protein Name:hemagglutinin-neuraminidase\|Gene Symbol:HN | MQPGISEVSFVNDERSERGTWRLLFRILTI VLCLTSIGIGIPALIYSKEAATSGDIDKSLEA VKTGMSTLSSKIDESINTEQKIYRQVILEAP VSQLNMESNILSAITSLSYQIDGTSNSSGCG SPMHDQDFVGGINKEIWTTDNVNLGEITL TPFLEHLNFIPAPTTGNGCTRIPSFDLGLTH WCYTHNVILSGCQDYSSSFQYIALGVLKIS ATGHVFLSTMRSINLDDERNRKSCSISATSI GCDIICSLVTEREVDDYNSPAATPMIHGRL DFSGKYNEVDLNVGQLFGDWSANYPGVG GGSFLNGRVWFPIYGGVKEGTPTFKENDG RYAIYTRYNDTCPDSESEQVSRAKSSYRPS YFGGKLVQQAVLSIKIDDTLGLDPVLTISN NSITLMGAESRVLQIEEKLYFYQRGTSWFP SLIMYPLTVDDKMVRFEPPTIFDQFTRPGN HPCSADSRCPNACVTGVYTDGYPIVFHNN HSIAAVYGMQLNDVTNRLNPRSAVWYGV SMSNVIRVSSSTTKAAYTTSTCFKVKKTQR VYCLSIGEIGNTLFGEFRIVPLLLEVYSEKG | 4 | 715 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | KSLKSSFDGWEDISINNPLRPLDNHRVDPIL ISNYTSSWP | | |
| AF092942 | 4705-5478 | gb:AF0929421 Organism:Bovine respiratory syncytial virus\|Strain Name:ATue51908\| Protein Name:attachment glycoprotein\| Gene Symbol:G | MSNHTHHLKFKTLKRAWKASKYFIVGLSC LYKFNLKSLVQTALTTLAMITLTSLVITAII YISVGNAKAKPTSKPTIQQTQQPQNHTSPF FTEHNYKSTHTSIQSTTLSQLPNTDTTRETT YSHSINETQNRKIKSQSTLPATRKPPINPSG SNPPENHQDHNNSQTLPYVPCSTCEGNLA CLSLCQIGPERAPSRAPTITLKKTPKPKTTK KPTKTTIHHRTSPEAKLQPKNNTAAPQQGI LSSPEHHTNQSTTQI | 3 | 716 |
| AF326114 | 6691-847 | gb:AF326114\| Organism:Men angle virus\|Strain Name:UNKNOWN-AF326114\|Protein Name:attachment protein\|Gene Symbol:HN | MWNSIPQLVSDHEEAKGKFTDIPLQDDTD SQHPSGSKSTCRTLFRTVSIILSLVILVLGVT STMFSAKYSGGCATNSQLLGVSNLINQIQK SIDSLISEVNQVSITTAVTLPIKIMDFGKSVT DQVTQMIRQCNTVCKGPGQKPGSQNVRI MPSNNLSTFQNINMSARGIAYQDVPLTFV RPIKNPQSCSRFPSYSVSFGVHCFANAVTD QTCELNQNTFYRVVLSVSKGNISDPSSLET KAETRTPKGTPVRTCSIISSVYGCYLLCSK ATVPESEEMKTIGFSQMFILYLSMDSKRIIY DNIVSSTSAIWSGLYPGEGAGIWHMGQLF FPLWGGIPFLTPLGQKILNSTLDIPEVGSKC KSDLTSNPAKTKDMLFSPYYGENVMVFGF LTCYLLSNVPTNCHADYLNSTVLGFGSKA QFYDYRGIVYMYIQSAGWYPFTQIFRITLQ LKQNRLQAKSIKRIEVTSTTRPGNRECSVL RNCPYICATGLFQVPWIVNSDAITSKEVDN MVFVQAWAADFTEFRKGILSLCSQVSCPI NDLLSKDNSYMRDTTTYCFPQTVPNILSCT SFVEWGGDSGNPINILEIHYEVIFVAS | 3 | 717 |
| GU206351 | 7500-9714 | gb:GU206351:7500-9714\| Organism:Avian paramyxovirus 5\|Strain Name:budgerigar/ Kunitachi/74\| Protein Name:hemagglutinin neuraminidase protein\|Gene Symbol:HN | MDKSYYTEPEDQRGNSRTWRLLFRLIVLT LLCLIACTSVSQLFYPWLPQVLSTLISLNSSI ITSSNGLKKEILNQNIKEDLIYREVAINIPLT LDRVTVEVGTAVNQITDALRQLQSVNGSA AFALSNSPDYSGGIEHLVFQRNTLINRSVS VSDLIEHPSFIPTPTTQHGCTRIPTFHLGTRH WCYSHNIIGQGCADSGASMMYISMGALG VSSLGTPTFTTSATSILSDSLNRKSCSIVATT EGCDVLCSIVTQTEDQDYADHTPTPMIHG RLWFNGTYTERSLSQSLFLGTWAAQYPAV GSGIMTPGRVIFPFYGGVIPNSPLFLDLERF ALFTHNGDLECRNLTQYQKEAIYSAYKPP KIRGSLWAQGFIVCSVGDMGNCSLKVINT STVMMGAEGRLQLVGDSVMYYQRSSSW WPVGILYRLSLVDIIARDIQVVINSEPLPLS KFPRPTWTPGVCQKPNVCPAVCVTGVYQ DLWAISAGETLSEMTFFGGYLEASTQRKD PWIGVANQYSWFMRRRLFKTSTEAAYSSS TCFRNTRLDRNFCLLIFELTDNLLGDWRIV PLLFELTIV | 3 | 718 |
| JQ001776 | 8170-10275 | gb:JQ001776:8170-10275\| Organism:Cedar virus\|Strain Name:CG1a\|Protein Name:attachment glycoprotein\| Gene Symbol:G | MLSQLQKNYLDNSNQQGDKMNNPDKKLS VNFNPLELDKGQKDLNKSYYVKNKNYNV SNLLNESLHDIKFCIYCIFSLLIIITIINIITISIV ITRLKVHEENNGMESPNLQSIQDSLSSLTN MINTEITPRIGILVTATSVTLSSSINYVGTKT NQLVNELKDYITKSCGFKVPELKLHECNIS CADPKISKSAMYSTNAYAELAGPPKIFCKS VSKDPDFRLKQIDYVIPVQQDRSICMNNPL LDISDGFFTYIHYEGINSCKKSDSFKVLLSH GEIVDRGDYRPSLYLLSSHYHPYSMQVINC VPVTCNQSSFVFCHISNNTKTLDNSDYSSD EYYITYFNGIDRPKTKKIPINNMTADNRYI | 3 | 719 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | HFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC | | |
| KP271123 | 6644-8431 | gb:KP271123:6644-8431\|Organism:Teviot virus\|Strain Name:Geelong\|Protein Name:attachment protein\|Gene Symbol:HN | MWSTQASKHPAMVNSATNLVDIPLDHPSSAQFPINRKRTGRLIYRLFSILCNLILISILISLVVIWSRSSRDCAKSDGLSSVDNQLSSLSRSINSLITEVNQISVTTAINLPIKLSEFGKSVVDQVTQMIRQCNAACKGPGEKPGIQNVRINIPNNFSTYSELNRTANSLNFQSRTALFARPNPYPKTCSRFPSYSVYFGIHCFSHAVTDSSCELSDSTYYRLVIGVADKNLSDPADVKYIGETTTPVRVQTRGCSVVSSIYGCYLLCSKSNQDYQDDFREQGFHQMFILFLSRELKTTFFDDMVSSTTVTWNGLYPGEGSGIWHMGHLVFPLWGGIRFGTHASEGILNSTLELPPVGPSCKRSLADNGLINKDVLFSPYFGDSVMVFAYLSCYMLSNVPTHCQVETMNSSVLGFGSRAQFYDLKGIVYLYIQSAGWFSYTQLFRLSLQSKGYKLSVKQIKRIPISSTSRPGTEPCDIIHNCPYTCATGLFQAPWIVNGDSIRDRDVRNMAFVQAWSGAINTFQRPFMSICSQYSCPLSELLDSESSIMRSTTTYCFPSLTESILQCVSFIEWGGPVGNPISINEVYSSISFRPD | 3 | 720 |
| AY286409 | 7644-9542 | gb:AY286409\|Organism:Mossman virus\|Strain Name:UNKNOWN-AY286409\|Protein Name:attachment glycoprotein\|Gene Symbol:G | MVDPPAVSYYTGTGRNDRVKVVTTQSTNPYWAHNPNQGLRRLIDMVVNVIMVTGVIFALINIILGIVIISQSAGSRQDTSKSLDIIQHVDSSVAITKQIVMENLEPKIRSILDSVSFQIPKLLSSLLGPGKTDPPIALPTKASTPVIPTEYPSLNTTTCLRIEESVTQNAAALFNISFDLKTVMYELVTRTGGCVTLPSYSELYTRVRTFSTAIRNPKTCQRAGQETDLNLIPAFIGTDTGILINSCVRQPVIATGDGIYALTYLTMRGTCQDHRHAVRHFEIGLVRRDAWWDPVLTPIHHFTEPGTPVFDGCSLTVQNQTALALCTLTTDGPETDIHNGASLGLALVHFNIRGEFSKHKVDPRNIDTQNQGLHLVTTAGKSAVKKGILYSFGYMVTRSPEPGDSKCVTEECNQNNQEKCNAYSKTTLDPDKPRSMIIFQIDVGAEYFTVDKVVVVPRTQYYQLTSGDLFYTGEENDLLYQLHNKGWYNKPIRGRVTFDGQVTLHEHSRTYDSLSNQRACNPRLGCPSTCELTSMASYFPLDKDFKAAVGVIALRNGMTPIITYSTDDWRNHWKYIKNADLEFSESSLSCYSPNPPLDDYVLCTAVITAKVMSNTNPQLLATSWYQYDKCHT | 2 | 721 |
| AY900001 | 7809-9938 | gb:AY900001\|Organism:J-virus\|Strain Name:UNKNOWN-AY900001\|Protein Name:attachment glycoprotein\|Gene Symbol:G | MNPVAMSNFYGINQADHLREKGDQPEKGPSVLTYVSLITGLLSLFTIIALNVTNIIYLTGSGGTMATIKDNQQSMSGSMRDISGMLVEDLKPKTDLINSMVSYTIPSQISAMSAMIKNEVLRQCTPSFMFNNTICPIAEHPVHTSYFEEVGIEAISMCTGTNRKLVVNQGINFVEYPSFIPGSTKPGGCVRLPSFSLGLEVFAYAHAITQDDCTSSSTPDYYFSVGRIADHGTDVPVFETLAEWFLDDKMNRRSCSVTAAGKGGWLGCSILVGSFTDELTSPEVNRISLSYMDTFGKKKDWLYTGSEVRADQSWSALFFSVGSGVVIGDTVYFLVWGGLNHPINVDAMCRAPGCQSPTQSLCNYAIKPQEWGGNQIVNGILHFKHDTNEKPTLHVRTLSPDNNWMGAEGRL | 2 | 722 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | FHFHNSGKTFIYTRSSTWHTLPQVGILTLG WPLSVQWVDITSISRPGQSPCEYDNRCPHQ CVTGVYTDLFPLGVSYEYSVTAYLDQVQS RMNPKIALVGAQEKIYEKTITTNTQHADY TTTSCFAYKLRVWCVSIVEMSPGVITTRQP VPFLYHLNLGCQDTSTGSLTPLDAHGGTY LNTDPVGNKVDCYFVLHEGQIYFGMSVGP INYTYSIVGRSREIGANMNVSLNQLCHSVY TEFLKEKEHPGTRNNIDVEGWLLKRIETLN GTKIFGLDDLEGSGPGHQSGPEDPSIAPIGH N | | |
| EF199772 | 6150-6944 | gb:EF199772:6150-6944\|Organism:Avian metapneumovirus\|Strain Name:PL-2\|Protein Name:attachment glycoprotein\|Gene Symbol:G | MEVKVENVGKSQELKVKVKNFIKRSDCK KKLFALILGLVSFELTMNIMLSVMYVESNE ALSLCRIQGTPAPRDNKTNTENATKETTLH TTTTTRDPEVRETKTTKPQANEGATNPSR NLTTKGDKHQTTRATTEAELEKQSKQTTE PGTSTQKHTPARPSSKSPTTTQATAQPTTP TAPKASTAPKNRQATTKKTETDTTTASRA RNTNNPTETATTTPKATTETGKGKEGPTQ HTTKEQPETTARETTTPQPRRTAGASPRAS | 2 | 723 |
| JF424833 | 5981-7156 | gb:JF424833:5981-7156\|Organism:Avian metapneumovirus\|Strain Name:IT/Ty/A/259-01/03\|Protein Name:attachment protein\|Gene Symbol:G | MGSKLYMVQGTSAYQTAVGFWLDIGRRY ILAIVLSAFGLTCTVTIALTVSVIVEQSVLE ECRNYNGGDRDWWSTTQEQPTTAPSATP AGNYGGLQTARTRKSESCLHVQISYGDM YSRSDTVLGGFDCMGLLVLCKSGPICQRD NQVDPTALCHCRVDLSSVDCCKVNKISTN SSTTSEPQKTNPAWPSQDNTDSDPNPQGIT TSTATLLSTSLGLMLTSKTGTHKSGPPQAL PGSNTNGKTTTDRELGSTNQPNSTTNGQH NKHTQRMTLPPSYDNTRTILQHTTPWEKT FSTYKPTHSPTNESDQSLPTTQNSINCEHFD PQGKEKICYRVGSYNSNITKQCRIDVPLCS TYNTVCMKTYYTEPFNCWRRIWRCLCDD GVGLVEWCCTS | 2 | 724 |
| JN689227 | 7918-12444 | gb:JN689227:7918-12444\|Organism:Tailam virus\|Strain Name:TL8K\|Protein Name:attachment glycoprotein\|Gene Symbol:G | MSQLAAHNLAMSNFYGIHQGGQSTSQKE EEQPVQGVIRYASMIVGLLSLFTIIALNVTN IIYMTESGGTMQSIKNAQGSIDGSMKDLSG TIMEDIKPKTDLINSMVSYNIPAQLSMIHQI IKNDVLKQCTPSFMFNNTICPLAENPTHSR YFEEVNLDSISECSGNEMSLELGTEPEFIEY PSFAPGSTKPGSCVRLPSFSLSSTVFAYTHT IMGHGCSELDVGDHYLAIGRIADAGHEIPQ FETISSWFINDKINRRSCTVAAGVMETWM GCVIMTETFYDDLDSLDTGKITISYLDVFG RKKEWIYTRSEILYDYTYTSVYFSIGSGVV VGDTVYFLLWGSLSSPIEETAYCYAPGCSN YNQRMCNEAQRPAKFGHRQMANAILRFK TNSMGKPSISVRTLSPTVIPFGTEGRLIYSD FTKIIYLYLRSTSWYVLPLTGLLILGPPVSIS WVTQEAVSRPGEYPCGASNRCPKDCITGV YTDLFPLGARYEYAVTVYLNAETYRVNPT LALIDRSKIIARKKITTESQKAGYTTTTCFV FKLRIWCMSVVELAPATMTAFEPVPFLYQ LDLTCKRNNGTTAMQFSGQDGMYKSGRY KSPRNECFFEKVSNKYYFVVSTPEGIQPYE VRDLTPERVSHVIMYISDVCAPALSAFKKL IPAMRPITTLTIGNWQFRPVDISGGLRVNIY RNLTRYGDLSMSAPEDPGTDTFPGTHAPS KGHEEVGHYTLPNEKLSEVTTAAVKTKES LNLIPDTKDTRGEEENGSGLNEIITGHTTPG HIKTHPAETKVTKHTVIIPQIEEDGSGATTS TELQDETGYHTEDYNTTNTNGSLTAPNER NNYTSGDHTVSGEDITHTITVSDRTKTTQT LPTDNTFNQTPTKIQEGSPKSESTPKDYTAI ESEDSHFTDPTLIRSTPEGTIVQVIGDQFHS | 2 | 725 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | AVTQLGESNAIGNSEPIDQGNNLIPTTDRG TMDNTSSQSHSSTTSTQGSHSAGHGSQSN MNLTALADTDSVTDQSTSTQEIDHEHENV SSILNPLSRHTRVMRDTVQEALTGAWGFIR GMIP | | |
| KC562242 | 6178-6926 | gb:KC562242:6178-6926\|Organism:Human metapneumovirus\|Strain Name:HMPV/USA/C1-334/2004/B\|Protein Name:attachment glycoprotein G\|Gene Symbol:G | MEVRVENIRAIDMFKAKIKNRIRNSRCYR NATLILIGLTALSMALNIFLIIDHATLRNMI KTENCANMPSAEPSKKTPMTSIAGPSTKPN PQQATQWTTENSTSPAATLEGHPYTGTTQ TPDTTAPQQTTDKHTALPKSTNEQITQTTT EKKTTRATTQKRKKEKKTQTKPQVQLQP KQPTPPTKSEMQVRQSQHPTDPELTPLPKA VNRQPGQQNQAPHHIMHGEVQDPGERNT QVSHPSS | 2 | 726 |
| KC915036 | 6154-7911 | gb:KC915036:6154-7911\|Organism:Avian metapneumovirus type C\|Strain Name:GDY\|Protein Name:attachment glycoprotein\|Gene Symbol:G | MEVKIENVGKSQELRVKVKNFIKRSDCKK KLFALILGLISFDITMNIMLSVMYVESNEA LSSCRVQGTPAPRDNRTNTENTAKETTLH TMTTTRNTEAGGTKTTKPQADERATSPSK NPTIGADKHKTTRATTEAEQEKQSKQTTE PGTSTPKHIPARPSSKSPATTKTTTQPTTPT VAKGGTAPKNRQTTTKKTEADTPTTSRAK QTNKPTGTETTPPRATTETDKDKEGPTQH TTKEQPETTAGGTTTPQPRRTTSRPAPTTN TKEGAETTGTRTTKSTQTSASPPRPTRSTPS KTATGTNKRATTTKGPNTASTDRRQQTRT TPKQDQQTQTKAKTTTNKAHAKAATTPE HNTDTTDSMKENSKEDKTTRDPSSKATTK QENTSKGTTATNLGNNTEAGARTPPTTTP TRHTTEPATSTAGGHTKARTTRWKSTAAR QPTRNNTTADTKTAQSKQTTPAQLGNNTT PENTTPPDNKSNSQTNVAPTEEIEIGSSLWR RRYVYGPCRENALEHPMNPCLKDNTTWI YLDNGRNLPAGYYDSKTDKIICYGIYRGN SYCYGRIECTCKNGTGLLSYCCNSYNWS | 2 | 727 |
| LC168749 | 7239-9196 | gb:LC168749:7239-9196\|Organism:Rinderpest morbillivirus\|Strain Name:Lv\|Protein Name:H protein\|Gene Symbol:H | MSSPRDRVNAFYKDNLQFKNTRVVLNKE QLLIERPYMLLAVLFVMFLSLVGLLAIAGI RLHRAAVNTAEINSGLTTSIDITKSIEYQVK DVLTPLFKIIGDEVGLRTPQRFTDLTKFISD KIKFLNPDKEYDFRDINWCISPPERIKINYD QYCAHTAAEELITMLVNSSLAGTAVLRTS LVNLGRSCTGSTTTKGQFSNMSLALSGIYS GRGYNISSMITITEKGMYGSTYLVGKHNQ GARRPSTAWQRDYRVFEVGIIRELGVGTP VFHMTNYLELPRQPELEICMLALGEFKLA ALCLADNSVALHYGGLRDDHKIRFVKLG VWPSPADSDTLATLSAVDPTLDGLYITTHR GIIAAGKAVWAVPVTRTDDQRKMGQCRR EACREKPPPFCNSTDWEPLEAGRIPAYGIL TIRLGLADKPEIDIISEFGPLITHDSGMDLYT PLDGNEYWLTIPPLQNSALGTVNTLVLEPS LKISPNILTLPIRSGGGDCYTPTYLSDLADD DVKLSSNLVILPSRNLQYVSATYDTSRVEH AIVYYIYSTGRLSSYYYPVKLPIKGDPVSL QIGCFPWGLKLWCHHFCSVIDSGTGKQVT HTGAVGIEITCNSR | 2 | 728 |
| LC187310 | 8144-9871 | gb:LC187310:8144-9871\|Organism:Avian paramyxovirus 10\|Strain Name:rAPMV-10-FI324/YmHA\| | MDSSQMNILDAMDRESSKRTWRGVFRVT TIIMVVTCVVLSAITLSKVAHPQGFDTNEL GNGIVDRVSDKITEALTVPNNQIGEIFKIVA LDLHVLVSSSQQAIAGQIGMLAESINSILSQ NGSASTILSSSPEYAGGIGVPLFSNKLTNGT VIKPITLIEHPSFIPGPTTIGGCTRIPTFHMAS SHWCYSHNIIEKGCKDSGISSMYISLGVLQ | 2 | 729 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | Protein Name:hemagglutinin-neuraminidase\| Gene Symbol:HN | VLKKGTPVFLVTASAVLSDDRNRKSCSIIS SRFGCEILCSLVTEAESDDYKSDTPTGMVH GRLYFNGTYREGLVDTETIFRDFSANYPG VGSGEIVEGHIHFPIYGGVKQNTGLYNSLT PYWLDAKNKYDYCKLPYTNQTIQNSYKPP FIHGRFWAQGILSCELDLFNLGNCNLKIIRS DKVMMGAESRLMLVGSKLLMYQRASSW WPLGITQEIDIAELHSSNTTILREVKPILSSK FPRPSYQPNYCTKPSVCPAVCVTGVYTDM WPISITGNISDYAWISHYLDAPTSRQQPRIG IANQYFWIHQTTIFPTNTQSSYSTTTCFRNQ VRSRMFCLSIAEFADGVFGEFRIVPLLYEL RV | | |
| NC_004074 | 6590-8563 | gb:NC_004074:6590-8563\| Organism:Tioman virus\|Strain Name:UNKNOWN-NC_004074\| Protein Name:attachment protein\|Gene Symbol:HN | MWATSESKAPIPANSTLNLVDVPLDEPQTI TKHRKQKRTGRLVFRLLSLVLSLMTVILV LVILASWSQKINACATKEGFNSLDLQISGL VKSINSLITEVNQISITTAINLPIKLSDFGKSI VDQVTQMIRQCNAVCKGPGEKPGIQNIRI NIPNNFSTYLELNNTVKSIELQRRPALLARP NPIPKSCSRFPSYSVNFGIHCFAHAITDQSC ELSDKTYYRLAIGISDKNLSDPSDVKYIGE AFTPMGLQARGCSVISSIYGCYLLCSKSNQ GYEADFQTQGFHQMYILFLSRDLKTTLFN DMISSTTVVWNGLYPGEGAGIWHMGYLIF PLWGGIKIGTPASTSILNSTLDLPLVGPSCK STLEENNLINKDVLFSPYFGESVMVFGFLS CYMLSNVPTHCQVEVLNSSVLGFGSRSQL MDLKGIVYLYIQSAGWYSYTQLFRLSLQS RGYKLTVKQIRRIPISSTTRPGTAPCDVVH NCPYTCATGLFQAPWIVNGDSILDRDVRN LVFVQAWSGNFNTFQKGLISICNQYTCPLT TLLDNDNSIMRSTTTYCYPSLSEYNLQCQS FIEWGGPVGNPIGILEVHYIIKFK | 2 | 730 |
| NC_005283 | 7091-8905 | gb:NC_005283:7091-8905\| Organism:Dolphin morbillivirus\| Strain Name:UNKNOWN-NC_005283\| Protein Name:haemagglutinin protein\|Gene Symbol:H | MSSPRDKVDAFYKDIPRPRNNRVLLDNER VIIERPLILVGVLAVMFLSLVGLLAIAGVRL QKATTNSIEVNRKLSTNLETTVSIEHHVKD VLTPLFKIIGDEVGLRMPQKLTEIMQFISNK IKFLNPDREYDFNDLHWCVNPPDQVKIDY AQYCNHIAAEELIVTKFKELMNHSLDMSK GRIFPPKNCSGSVITRGQTIKPGLTLVNIYT TRNFEVSFMVTVISGGMYGKTYFLKPPEP DDPFEFQAFRIFEVGLVRDVGSREPVLQMT NFMVIDEDEGLNFCLLSVGELRLAAVCVR GRPVVTKDIGGYKDEPFKVVTLGIIGGGLS NQKTEIYPTIDSSIEKLYITSHRGIIRNSKAR WSVPAIRSDDKDKMEKCTQALCKSRPPPS CNSSDWEPLTSNRIPAYAYIALEIKEDSGLE LDITSNYGPLIIHGAGMDIYEGPSSNQDWL AIPPLSQSVLGVINKVDFTAGFDIKPHTLTT AVDYESGKCYVPVELSGAKDQDLKLESNL VVLPTKDFGYVTATYDTSRSEHAIVYYVY DTARSSSYFFPFRIKARGEPIYLRIECFPWS RQLWCHHYCMINSTVSNEIVVVDNLVSIN MSCSR | 2 | 731 |
| NC_007803 | 7978-12504 | gb:NC_007803:7978-12504\| Organism:Beilong virus\|Strain Name:Li\|Protein Name:attachment glycoprotein\| Gene Symbol:G | MSQLAAHNLAMSNFYGTHQGDLSGSQKG EEQQVQGVIRYVSMIVSLLSLFTIIALNVTN IIYMTESGGTMQSIKTAQGSIDGSMREISG VIMEDVKPKTDLINSMVSYNIPAQLSMIHQ IIKNDVPKQCTPSFMFNNTICPLAENPTHSR YFEEVNLDSISECSGPDMHLGLGVNPEFIE FPSFAPGSTKPGSCVRLPSFSLSTTVFAYTH TIMGHGCSELDVGDHYFSVGRIADAGHEIP QFETISSWFINDKINRRSCTVAAGAMEAW MGCVIMTETFYDDRNSLDTGKLTISYLDV FGRKKEWIYTRSEILYDYTYTSVYFSVGSG | 2 | 732 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | VVVGDTVYFLIWGSLSSPIEETAYCFAPDC SNYNQRMCNEAQRPSKFGHRQMVNGILK FKTTSTGKPLLSVGTLSPSVVPFGSEGRLM YSEITKIIYLYLRSTSWHALPLTGLFVLGPP TSISWIVQRAVSRPGEFPCGASNRCPKDCV TGVYTDLFPLGSRYEYAATVYLNSETYRV NPTLALINQTNIIASKKVTTESQRAGYTTTT CFVFKLRVWCISVVELAPSTMTAYEPIPFL YQLDLTCKGKNGSLAMRFAGKEGTYKSG RYKSPRNECFFEKVSNKYYFIVSTPEGIQP YEIRDLTPDRMPHIIMYISDVCAPALSAFK KLLPAMRPITTLTIGNWQFRPVEVSGGLRV NIGRNLTKEGDLTMSAPEDPGSNTFPGNHI PGNGILDAGYYTVEYPKE | | |
| NC_009489 | 6559-8512 | gb:NC_009489:6559-8512\|Organism:Mapuera virus\|Strain Name:BeAnn 370284\|Protein Name:attachment protein\|Gene Symbol:HN | MASLQSEPGSQKPHYQSDDQLVKRTWRSF FRFSVLVVTITSLALSIITLIGVNRISTAKQIS NAFAAIQANILSSIPDIRPINSLLNQLVYTSS VTLPLRISSLESNVLAAIQEACTYRDSQSSC SATMSVMNDQRYIEGIQVYSGSFLDLQKH TLSPPIAFPSFIPTSTTTVGCTRIPSFSLTKTH WCYTHNYIKTGCRDATQSNQYIALGTIYT DPDGTPGFSTSRSQYLNDGVNRKSCSISAV PMGCALYCFISVKEEVDYYKGTVPPAQTLI LFFFNGTVHEHRIVPSSMNSEWVMLSPGV GSGVFYNNYIIFPLYGGMTKDKAEKRGEL TRFFTPKNSRSLCKMNDSVFSNAAQSAYY PPYFSSRWIRSGLLACNWNQIITTNCEILTF SNQVMMMGAEGRLILINDDLFYYQRSTS WWPRPLVYKLDIELNYPDSHIQRVDQVEV TFPTRPGWGGCVGNNFCPMICVSGVYQD VWPVTNPVNTTDSRTLWVGGTLLSNTTRE NPASVVTSGGSISQTVSWFNQTVPGAYSTT TCFNDQVQGRIFCLIIFEVGGGLLGEYQIVP FLKELKYQGAVHA | 2 | 733 |
| NC_017937 | 6334-8544 | gb:NC_017937:6334-8544\|Organism:Nariva virus\|Strain Name:UNKNOWN-NC_017937\|Protein Name:attachment protein\|Gene Symbol:H | MAPINYPASYYTNNAERPVVITTKSTESKG QRPLPLGNARFWEYFGHVCGTLTFCMSLI GIIVGIIALANYSSDKDWKGRIGGDIQVTR MATEKTVKLILEDTTPKLRNILDSVLFQLP KMLASIASKINTQTPPPPTTSGHSTALATQ CSSNCENRPEIGYDYLRQVEQSLQRITNISI QLLEASEIHSMAGAYPNALYKIRTQDSWS VTAKECPLQAFQPNLNLIPAMIGTATGALI RNCVRQPVIVVDDGVYMLTYLAMRGSCQ DHQKSVRHFEMGVITSDPFGDPVPTPLRH WTKRALPAYDGCALAVKGHAGFALCTET SVGPLRDRTAKRKPNIVLFKASLVGELSER VIPPQSWLSGFSFFSVYTVAGKGYAYHSKF HAFGNVVRVGQSEYQAKCRGTGCPTANQ DDCNTAQRVSQEDNTYLHQAILSVDIDSVI DPEDVVYVIERDQYYQASAGDLYRVPETG EILYNLHNGGWSNEVQVGRIQPSDRFYMR EIQLTSTRVPAPNGCNRVKGCPGGCVAVIS PAFTPMHPEFNVGVGIFPMNQPHNPSIMH VQQQTELFWKPIVGGNITLHESSIACYSTV PPNPSYDLCIGVMTLLLHQGQLPQFQALS WYQPTMCNGNAPQNRRALIPVIVEDSKA MSVSSDAPRTP | 2 | 734 |
| NC_025256 | 9117-11015 | gb:NC_025256:9117-11015\|Organism:Bat Paramyxovirus Eid_hel/GH-M74a/GHA/2009\|Strain Name:BatPV/Eid_hel/GH- | MPQKTVEFINMNSPLERGVSTLSDKKTLN QSKITKQGYFGLGSHSERNWKKQKNQND HYMTVSTMILEILVVLGIMFNLIVLTMVYY QNDNINQRMAELTSNITVLNLNLNQLTNKI QREIIPRITLIDTATTITIPSAITYILATLTTRI SELLPSINQKCEFKTPTLVLNDCRINCTPPL NPSDGVKMSSLATNLVAHGPSPCRNFSSV PTIYYYRIPGLYNRTALDERCILNPRLTISST | 2 | 735 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

<table>
<tr><th>Gen bank ID</th><th>Nucleotides of CDS</th><th>Full sequence ID</th><th>#Sequences/ Sequence</th><th>Cluster</th><th>SEQ ID NO</th></tr>
<tr><td></td><td></td><td>M74a/GHA/<br>2009|Protein<br>Name:glycoprotein|<br>Gene<br>Symbol:G</td><td>KFAYVHSEYDKNCTRGFKYYELMTFGEIL<br>EGPEKEPRMFSRSFYSPTNAVNYHSCTPIV<br>TVNEGYFLCLECTSSDPLYKANLSNSTFHL<br>VILRHNKDEKIVSMPSFNLSTDQEYVQIIPA<br>EGGGTAESGNLYFPCIGRLLHKRVTHPLC<br>KKSNCSRTDDESCLKSYYNQGSPQHQVVN<br>CLIRIRNAQRDNPTWDVITVDLTNTYPGSR<br>SRIFGSFSKPMLYQSSVSWHTLLQVAEITD<br>LDKYQLDWLDTPYISRPGGSECPFGNYCP<br>TVCWEGTYNDVYSLTPNNDLFVTVYLKSE<br>QVAENPYFAIFSRDQILKEFPLDAWISSART<br>TTISCFMFNNEIWCIAALEITRLNDDIIRPIY<br>YSFWLPTDCRTPYPHTGKMTRVPLRSTYN<br>Y</td><td></td><td></td></tr>
<tr><td>NC_025347</td><td>6398-8418</td><td>gb:NC_025347:6398-8418|<br>Organism:Avian<br>paramyxovirus<br>7|Strain<br>Name:APMV-<br>7/dove/Tennessee/<br>4/75|Protein<br>Name:hemagglutinin-<br>neuraminidase|<br>Gene<br>Symbol:HN</td><td>MESIGKGTWRTVYRVLTILLDVVIIILSVIA<br>LISLGLKPGERIINEVNGSIHNQLVPLSGITS<br>DIQAKVSSIYRSNLLSIPLQLDQINQAISSSA<br>RQIADTINSFLALNGSGTFIYTNSPEFANGF<br>NRAMFPTLNQSLNMLTPGNLIEFTNFIPTPT<br>TKSGCIRIPSFSMSSSHWCYTHNIIASGCQD<br>HSTSSEYISMGVVEVTDQAYPNFRTTLSIT<br>LADNLNRKSCSIAATGFGCDILCSVVTETE<br>NDDYQSPEPTQMIYGRLFFNGTYSEMSLN<br>VNQMFADWVANYPAVGSGVELADFVIFP<br>LYGGVKITSTLGASLSQYYYIPKVPTVNCS<br>ETDAQQIEKAKASYSPPKVAPNIWAQAVV<br>RCNKSVNLANSCEILTFNTSTMMMGAEGR<br>LLMIGKNVYFYQRSSSYWPVGIIYKLDLQE<br>LTTFSSNQLLSTIPIPFEKFPRPASTAGVCSK<br>PNVCPAVCQTGVYQDLWVLYDLGKLENT<br>TAVGLYLNSAVGRMNPFIGIANTLSWYNT<br>TRLFAQGTPASYSTTTCFKNTKIDTAYCLSI<br>LELSDSLLGSWRITPLLYNITLSIMS</td><td>2</td><td>736</td></tr>
<tr><td>NC_025348</td><td>6590-8548</td><td>gb:NC_025348:6590-8548|<br>Organism:Tuhokovirus<br>2|Strain<br>Name:UNKNOWN-<br>NC_025348|<br>Protein<br>Name:hemagglutinin-<br>neuraminidase|<br>Gene<br>Symbol:HN</td><td>MPPVPTVSQSIDEGSFTDIPLSPDDIKHPLS<br>KKTCRKLFRIVTLIGVGLISILTIISLAQQTGI<br>LRKVDSSDFQSYVQESFKQVLNLMKQFSS<br>NLNSLIEITSVTLPFRIDQFGTDIKTQVAQL<br>VRQCNAVCRGPIKGPTTQNIVYPALYETSL<br>NKTLETKNVRIQEVRQEVDPVPGPGLSNG<br>CTRNPSFSVYHGVWCYTHATSIGNCNGSL<br>GTSQLFRIGNVLEGDGGAPYHKSLATHLL<br>TTRNVSRQCSATASYYGCYFICSEPVLTER<br>DDYETPGIEPITIFRLDPDGNWVVFPNINRF<br>TEYSLKALYPGIGSGVLFQGKLIFPMYGGI<br>DKERLSALGLGNIGLIERRMADTCNHTEK<br>ELGRSFPGAFSSPYYHDAVMLNFLLICEMI<br>ENLPGDCDLQILNPTNMSMGSESQLSVLD<br>NELFLYQRSASWWPYTLIYRLNMRYTGK<br>YLKPKSIIPMVIKSNTRPGYEGCNHERVCP<br>KVCVTGVFQAPWILSIGRDHKERVSNVTY<br>MVAWSMDKSDRTYPAVSVCGSDTCKLTV<br>PLGDSKVHSAYSVTRCYLSRDHMSAYCLV<br>IFELDARPWAEMRIQSFLYKLILT</td><td>2</td><td>737</td></tr>
<tr><td>NC_025350</td><td>6451-8341</td><td>gb:NC_025350:6451-8341|<br>Organism:Tuhokovirus<br>3|Strain<br>Name:UNKNOWN-<br>NC_025350|<br>Protein<br>Name:hemagglutinin-<br>neuraminidase|<br>Gene<br>Symbol:HN</td><td>MHNRTQSVSSIDTSSDVYLPRRKKAVTKF<br>TFKKIFRVLILTLLLSIIIIIAVIFPKIDHIRETC<br>DNSQILETITNQNSEIKNLINSAITNLNVLLT<br>STTVDLPIKLNNFGKSIVDQVTMMVRQCN<br>AVCRGPGDRPTQNIELFKGLYHTSPPSNTS<br>TKLSMITEASNPDDIVPRPGKLLGCTRFPSF<br>SVHYGLWCYGHMASTGNCSGSSPSVQIIRI<br>GSIGTNKDGTPKYVIIASASLPETTRLYHCS<br>VTMTSIGCYILCTTPSVSETDDYSTMGIEK<br>MSISFLSLDGYLTQLGQPTGLDNQNLYAL<br>YPGPGSGVIFRDFLIFPMMGGIRLMDAQK<br>MLNRNITYRGFPPSETCTESELKLKQEVAN</td><td>2</td><td>738</td></tr>
</table>

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | MLTSPYYGEVLVLNFLYVCSLLDNIPGDCS VQLIPPDNMTLGAESRLYVLNGSLIMYKR GSSWWPYTELYQINYRVNNRAFRVRESVR INTTSTSRPGVQGCNLEKVCPKVCVSGIYQ SPGIISAPVNPTRQEEGLLYFLVWTSSMSSR TGPLSSLCDHSTCRITYPIGDDTIFIGYTDSS CFMSSIKEGIYCIAFLELDNQPYSMMAIRSL SYIIN | | |
| NC_025352 | 8716-11257 | gb:NC_025352:8716-11257\|Organism:Mojiang virus\|Strain Name:Tongguan1\|Protein Name:attachment glycoprotein\|Gene Symbol:G | MATNRDNTITSAEVSQEDKVKKYYGVET AEKVADSISGNKVFILMNTLLILTGAIITITL NITNLTAAKSQQNMLKIIQDDVNAKLEMF VNLDQLVKGEIKPKVSLINTAVSVSIPGQIS NLQTKFLQKYVYLEESITKQCTCNPLSGIF PTSGPTYPPTDKPDDDTTDDDKVDTTIKPI EYPKPDGCNRTGDHFTMEPGANFYTVPNL GPASSNSDECYTNPSFSIGSSIYMFSQEIRK TDCTAGEILSIQIVLGRIVDKGQQGPQASPL LVWAVPNPKIINSCAVAAGDEMGWVLCS VTLTAASGEPIPHMFDGFWLYKLEPDTEV VSYRITGYAYLLDKQYDSVFIGKGGGIQK GNDLYFQMYGLSRNRQSFKALCEHGSCL GTGGGGYQVLCDRAVMSFGSEESLITNAY LKVNDLASGKPVIIGQTFPPSDSYKGSNGR MYTIGDKYGLYLAPSSWNRYLRFGITPDIS VRSTTWLKSQDPIMKILSTCTNTDRDMCP EICNTRGYQDIFPLSEDSEYYTYIGITPNNG GTKNFVAVRDSDGHIASIDILQNYYSITSA TISCFMYKDEIWCIAITEGKKQKDNPQRIY AHSYKIRQMCYNMKSATVTVGNAKNITIR RY | 2 | 739 |
| NC_025363 | 6503-8347 | gb:NC_025363:6503-8347\|Organism:Avian paramyxovirus 12\|Strain Name:Wigeon/Italy/3920_1/2005\|Protein Name:hemagglutinin-neuraminidase\|Gene Symbol:HN | MESATSQVSFENDKTSDRRTWRAVFRVL MIILALSSLCVTVAALIYSAKAAIPGNIDAS EQRILSSVEAVQVPVSRLEDTSQKIYRQVIL EAPVTQLNMETNILNAITSLSYQIDASANS SGCGAPVHDSDFTGGVGRELLQEAEVNLT IIRPSKFLEHLNFIPAPTTGNGCTRIPSFDLG QTHWCYTHNVVLNGCRDRGHSFQYVALG ILRTSATGSVFLSTLRSVNLDDDRNRKSCS VSATPIGCEMLCSLVTETEEGDYDSIDPTP MVHGRLGFDGKYREVDLSEKEIFADWRA NYPAVGGGAFFGNRVWFPVYGGLKEGTQ SERDAEKGYAIYKRFNNTCPDDNTTQIAN AKASYRPSRFGGRFIQQGILSFKVEGNLGS DPILSLTDNSITLMGAEARVMNIENKLYLY QRGTSWFPSALVYPLDVANTAVKVRAPYI FDKFTRPGGHPCSASSRCPNVCVTGVYTD AYPLVFSRSHDIVAVYGMQLAAGTARLDP QAAIWYGNEMSTPTKVSSSTTKAAYTTST CFKVTKTKRIYCISIAEIGNTLFGEFRIVPLL IEVQKTPLTRRSELRQQMPQPPIDLVIDNPF CAPSGNLSRKNAIDEYANSWP | 2 | 740 |
| NC_025373 | 6619-8605 | gb:NC_025373:6619-8605\|Organism:Avian paramyxovirus 3\|Strain Name:turkey/Wisconsin/68\|Protein Name:hemagglutinin\|Gene Symbol:HN | MEPTGSKVDIVPSQGTKRTCRTFYRLLILIL NLIIIILTIISIYVSISTDQHKLCNNEADSLLH SIVEPITVPLGTDSDVEDELREIRRDTGINIP IQIDNTENIILTTLASINSNIARLHNATDESP TCLSPVNDPRFIAGINKITKGSMIYRNFSNL IEHVNFIPSPTTLSGCTRIPSFSLSKTHWCYS HNVISTGCQDHAASSQYISIGIVDTGLNNE PYLRTMSSRLLNDGLNRKSCSVTAGAGVC WLLCSVVTESESADYRSRAPTAMILGRFN FYGDYTESPVPASLFSGRFTANYPGVGSGT QLNGTLYFPIYGGVVNDSDIELSNRGKSFR PRNPTNPCPDPEVTQSQRAQASYYPTRFGR LLIQQAILACRISDTTCTDYYLLYFDNNQV MMGAEARIYYLNNQMYLYQRSSSWWPH | 2 | 741 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | PLFYRFSLPHCEPMSVCMITDTHLILTYATS RPGTSICTGASRCPNNCVDGVYTDVWPLT EGTTQDPDSYYTVFLNSPNRRISPTISIYSY NQKISSRLAVGSEIGAAYTTSTCFSRTDTG ALYCITIIEAVNTIFGQYRIVPILVQLISD | | |
| NC_025386 | 7541-9403 | gb:NC_025386:7541-9403\|Organism:Salem virus\|Strain Name:UNKNOWN-NC_025386\|Protein Name:attachment glycoprotein\|Gene Symbol:G | MKAMHYYKNDFADPGTNDNSSDLTTNPFI SNQIKSNLSPPVLAEGHLSPSPIPKFRKILLT ISFVSTIVVLTVILLVLTIRILTIIEASAGDEK DIHTILSSLLNTFMNEYIPVFKNLVSIISLQIP QMLIDLKTSSTQMMQSLKTFPRDLETLST VTQSVAVLLEKAKSTIPDINKFYKNVGKV TFNDPNIKVLTLEVPAWLPIVRQCLKQDFR QVISNSTGFALIGALPSQLFNEFEGYPSLAI VSEVYAITYLKGVMFENQENFLYQYFEIG TISPDGYNKPYFLRHTSVMLSTFKLSGKCT AAVDYRGGIFLCTPSPKIPKILQNPPDLPTL TVVSIPFDGRYTIRNISLMLTDEADIIYDLD TLQGRGVLQAMRFYALVRVISSSSPRHFPF CKNSWCPTADDKICDQSRRLGADGNYPV MYGLISIPAHSSYQGNVSLKLIDPKYYAYT RDASLFYNSMTDTYHYSFGTRGWVSRPII GELLLGDDIVLTRYTVRSVSRATAGDCTT VSMCPQACSGGMNSIFYPLNFDKPQVTGV AIRQYERQQEGIIVVTMNDHYYYSVPIIKN GTLLISSVTDCFWLMGDLWCMSLMEKNN LPLGVRSLAHLTWNIHWSCS | 2 | 742 |
| NC_025390 | 6647-8386 | gb:NC_025390:6647-8386\|Organism:Avian paramyxovirus 9\|Strain Name:duck/New York/22/1978\|Protein Name:hemagglutinin-neuraminidase\|Gene Symbol:HN | MESGISQASLVNDNIELRNTWRTAFRVVS LLLGFTSLVLTACALHFALNAATPADLSSI PVAVDQSHHEILQTLSLMSDIGNKIYKQVA LDSPVALLNTESTLMSAITSLSYQINNAAN NSGCGAPVHDKDFINGVAKELFVGSQYNA SNYRPSRFLEHLNFIPAPTTGKGCTRIPSFD LAATHWCYTHNVILNGCNDHAQSYQYISL GILKVSATGNVFLSTLRSINLDDDENRKSC SISATPLGCDLLCAKVTEREEADYNSDAAT RLVHGRLGFDGVYHEQALPVESLFSDWV ANYPSVGGGSYFDNRVWFGVYGGIRPGS QTDLLQSEKYAIYRRYNNTCPDNNPTQIER AKSSYRPQRFGQRLVQQAILSIRVEPSLGN DPKLSVLDNTVVLMGAEARIMTFGHVAL MYQRGSSYFPSALLYPLSLTNGSAAASKPF IFEQYTRPGSPPCQATARCPNSCVTGVYTD AYPLFWSEDHKVNGVYGMMLDDITSRLN PVAAIFDRYGRSRVTRVSSSSTKAAYTTNT CFKVVKTKRVYCLSIAEIENTLFGEFRITPL LSEIIFDPNLEPSDTSRN | 2 | 743 |
| NC_025403 | 6692-8645 | gb:NC_025403:6692-8645\|Organism:Achimota virus 1\|Strain Name:UNKNOWN-NC_025403\|Protein Name:attachment protein\|Gene Symbol:HN | MATNLSTITNGKFSQNSDEGSLTELPFFEH NRKVATTKRTCRFVFRSVITLCNLTILIVTV VVLFQQAGFIKRTESNQVCETLQNDMHGV VTMSKGVITTLNNLIEITSVNLPFQMKQFG QGIVTQVTQMVRQCNAVCKGPTIGPDIQNI VYPASYESMIKHPVNNSNILLSEIRQPLNFV PNTGKLNGCTRTPSFSVYNGFWCYTHAES DWNCNGSSPYMQVFRVGVVTSDYDYNVI HKTLHTKTSRLANVTYQCSTISTGYECYFL CSTPNVDEITDYKTPGIESLQIYKIDNRGTF AKFPITDQLNKELLTALYPGPGNGVLYQG RLLFPMHGGMQSSELNKVNLNNTVLSQFN DNKGCNATEIKLESEFPGTFTSPYYSNQVM LNYILICEMIENLPGNCDLQIVAPKNMSMG SESQLYSINNKLYLYQRSSSRWPYPLIYEV GTRLTNRQFRLRAINRFLIKSTTRPGSEGC NIYRVCPKVCVTGVYQAPWILHVSKAGSQ | 2 | 744 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | SIAKVLYAVAWSKDHMSRKGPLFSICDND TCFLTKSLASEHVHSGYSITRCYLENSERHI ICVVIMELDASPWAEMRIQSVIYNITLPS | | |
| NC_025404 | 6655-8586 | gb:NC_025404:6655-8586\|Organism:Achimota virus 2\|Strain Name:UNKNOWN-NC_025404\|Protein Name:attachment protein\|Gene Symbol:HN | MDNSMSISTISLDAQPRIWSRHESRRTWRN IFRITSLVLLGVTVIICIWLCCEVARESELEL LASPLGALIMAINTIKSSVVKMTTELNQVT FTTSIILPNKVDQFGQNVVSQVAQLVKQC NAVCRGHQDTPELEQFINQKNPTWILQPN YTTKLTNLHEIDSIIPLVDYPGFSKSCTRFPS FSEGSKFWCFTYAVVKEPCSDISSSIQVVK YGAIKANHSDGNPYLVLGTKVLDDGKFR RGCSITSSLYGCYLLCSTANVSEVNDYAHT PAYPLTLELISKDGITTDLSPTYTVQLDKW SALYPGIGSGVIFKGYLMFPVYGGLPFKSP LISASWVGPGNKWPVDFSCSEDQYSTFNF SNPYSALYSPHFSNNIVVSALFVCPLNENL PYSCEVQVLPQGNLTIGAEGRLYVIDQDL YYYQRSTSWWPYLQLYKLNIRITNRVFRV RSLSLLPIKSTTRPGYGNCTYFKLCPHICVT GVYQSPWLISIRDKRPHEEKNILYFIGWSP DEQIRQNPLVSLCHETACFINRSLATNKTH AGYSESHCVQSFERNKLTCTVFYELTAKP WAEMRVQSLLFQVDFL | 2 | 745 |
| NC_025410 | 6799-8869 | gb:NC_025410:6799-8869\|Organism:Tuhoko virus 1\|Strain Name:UNKNOWN-NC_025410\|Protein Name:hemagglutinin-neuraminidase\|Gene Symbol:HN | MDSRSDSFTDIPLDNRIERTVTSKKTWRSIF RVTAIILLIICVVVSSISLNQHNDAPLNGAG NQATSGFMDAIKSLEKLMSQTINELNQVV MTTSVQLPNRITKFGQDILDQVTQMVRQC NAVCRGPGVGPSIQNYVIQGHAPTVSFDPI SAEYQKFVFGITEKTLITAYHNPWECLRFP SQHLFDTTWCVSYQILTQNCSDHGPRITVI QLGEIMIANNLSTVFRDPVIKYIRHHIWLRS CSVVAYYSQCTIFCTSTNKSEPSDYADTGY EQLFLATLQSDGTFTEHSMHGVNIVHQWN AIYGGVGNGVIIGRNMLIPLYGGINYYDHN TTIVQTVDLRPYPIPDSCSQTDNYQTNYLP SMFTNSYYGTNLVVSGYLSCRLMAGTPTS CSIRVIPIENMTMGSEGQFYLINNQLYYYK RSSNWIRDTQVYLLSYSDKGNIIEITSAERY IFKSVTSPDEGDCVTNHGCPSNCIGGLFQA PWILNDFKLCGSNITCPKIVTVWADQPDK RSNPMLSIAETDKLLLHKSYINYHTAVGYS TVLCFDSPKLNLKTCVVLQELMSDDKLLI RISYSIVSIMVE | 2 | 746 |
| NC_028249 | 7059-9010 | gb:NC_028249:7059-9010\|Organism:Phocine distemper virus\|Strain Name:PDV/Wadden_Sea.NLD/1988\|Protein Name:hemagglutinin protein\|Gene Symbol:H | MFSHQDKVGAFYKNNARANSSKLSLVTD EVEERRSPWFLSILLILLVGILILLAITGIRFH QVVKSNLEFNKLLIEDMEKTKAVHHQVK DVLTPLFKIIGDEVGLRLPQKLNEIKQFIVQ KTNFFNPNREFDFRELHWCINPPSKVKVNF TQYCEITEFKEATRSVANSILLLTLYRGRD DIFPPYKCRGATTSMGNVFPLAVSLSMSLI SKPSEVINMLTAISEGIYGKTYLLVTDDTE ENFETPEIRVFEIGFINRWLGDMPLFQTTN YRIISNNSNTKICTIAVGELALASLCTKESTI LLNLGDEESQNSVLVVILGLFGATHMDQL EEVIPVAHPSIEKIHITNHRGFIKDSVATWM VPALALSEQGEQINCLRSACKRRTYPMCN QTSWEPFGDKRLPSYGRLTLSLDVSTDLSI NVSVAQGPIIFNGDGMDYYEGTLLNSGWL TIPPKNGTILGLINQASKGDQFIVTPHILTFA PRESSTDCHLPIQTYQIQDDDVLLESNLVV LPTQSFEYVVATYDVSRSDHAIVYYVYDP ARTVSYTYPFRLRTKGRPDILRIECFVWDG HLWCHQFYRFQLDATNSTSVVENLIRIRFS CDRLDP | 2 | 747 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| NC_028362 | 6951-8675 | gb:NC_028362:6951-8675\|Organism:Caprine parainfluenza virus 3\|Strain Name:JS2013\|Protein Name:hemagglutinin-neuraminidase\|Gene Symbol:HN | MEYWGHTNNPDKINRKVGVDQVRDRSKTLKIITFIISMMTSIMSTVALILILIMFIQNNNNNRIILQELRDETDAIEARIQKASNDIGVSIQSGINTRLLTIQNHVQNYIPLALTQQVSSLRESINDVITKREETQSKMPIQRMTHDDGIEPLIPDNFWKCPSGIPTISASPKIRLIPGPGLLATSTTINGCIRLPSLVINNLIYAYTSNLITQGCQDIGKSYQVLQIGIITINSDLVPDLNPRITHTFDIDDNRKSCSLALRNADVYQLCSTPKVDERSDYSSIGIEDIVLDIVTSEGTVSTTRFTNNNITFDKPYAALYPSVGPGIYYDNKIIFLGYGGLEHEENGDVICNITGCPGKTQHDCNQASYSPWFSNRRMVNAIILVNKGLNKVPSLQVWTIPMRQNYWGSEGRLLLLGNKIYIYTRSTSWHSKLQLGTLDISNYNDIRIRWTHHDVLSRPGSEECPWGNTCPRGCITGVYNDAYPLNPSGSVVSSVILDSRTSRENPIITYSTDTSRVNELAIRNNTLSAAYTTTNCVTHYGKGYCFHIIEINHKSLNTLQPMLFKTEIPKSCN | 2 | 748 |
| AB548428 | 5999-7261 | gb:AB548428:5999-7261\|Organism:Avian metapneumovirus\|Strain Name:VCO3/60616\|Protein Name:attachment glycoprotein\|Gene Symbol:G | MGSELYIIEGVSSSEIVLKQVLRRSKKILLGLVLSALGLTLTSTIVISICISVEQVKLRQCVDTYWAENGSLHPGQSTENTSTRGKTTTKDPRRLQATGAGKFESCGYVQVVDGDMHDRSYAVLGGVDCLGLLALCESGPICQGDTWSEDGNFCRCTFSSHGVSCCKKPKSKATTAQRNSKPANSKSTPPVHSDRASKEHNPSQGEQPRRGPTSSKTTIASTPSTEDTAKPTISKPKLTIRPSQRGPSGSTKAASSTPSHKTNTRGTSKTTDQRPRTGPTPERPRQTHSTATPPPTTPIHKGRAPTPKPTTDLKVNPREGSTSPTAIQKNPTTQSNLVDCTLSDPDEPQRICYQVGTYNPSQSGTCNIEVPKCSTYGHACMATLYDTPFNCWRRTRRCICDSGGELIEWCCTSQ | 1 | 749 |
| AF079780 | 8118-10115 | gb:AF079780\|Organism:Tupaia paramyxovirus\|Strain Name:UNKNOWN-AF079780\|Protein Name:hemagglutinin\|Gene Symbol:H | MDYHSHTTQTGSNETLYQDPLQSQSGSRDTLDGPPSTLQHYSNPPPYSEEDQGIDGPQRSQPLSTPHQYDRYYGVNIQHTRVYNHLGTIYKGLKLAFQILGWVSVIITMIITVTTLKKMSDGNSQDSAMLKSLDENFDAIQEVANLLDNEVRPKLGVTMTQTTFQLPKELSEIKRYLLRLERNCPVCGTEATPQGSKGNASGDTAFCPPCLTRQCSEDSTHDQGPGVEGTSRNHKGKINFPHILQSDDCGRSDNLIVYSINLVPGLSFIQLPSGTKHCIIDVSYTFSDTLAGYLIVGGVDGCQLHNKAIIYLSLGYYKTKMIYPPDYIAIATYTYDLVPNLRDCSIAVNQTSLAAICTSKKTKENQDFSTSGVHPFYIFTLNTDGIFTVTVIEQSQLKLDYQYAALYPATGPGIFIGDHLVFLMWGGLMTKAEGDAYCQASGCNDAHRTSCNIAQMPSAYGHRQLVNGLLMLPIKELGSHLIQPSLETISPKINWAGGHGRLYYNWEINTTYIYIEGKTWRSRPNLGIISWSKPLSIRWIDHSVARRPGARPCDSANDCPEDCLVGGYYDMFPMSSDYKTAITIIPTHHQWPSSPALKLFNTNREVRVVMILRPPNNVKKTTISCIRIMQTNWCLGFIIFKEGNNAWGQIYSYIYQVESTCPNTK | 1 | 750 |
| AY590688 | 6138-7935 | gb:AY590688:6138-7935\|Organism:Avian metapneumovirus\|Strain Name:Colorado\|Protein Name:attachment glycoprotein\|Gene Symbol:G | MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPTRPSSKSPTTTQAIAQLTTPTTPKASTAPKNRQATTKKTETDTTTASRARNTNNPTETATTTPKATTETGKSKEGPTQHTTKEQPETTAGETTTPQPRRTASRPAPTTKIE | 1 | 751 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | EEAETTKTRTTKSTQTSTGPPRPTGGAPSG AATEGSGRAAAAGGPSAASAGGRRRTEA AAERDRRTRAGAGPTAGGARARTAAASE RGADTAGSAGGGPGGDGATGGLSGGAPA EREDASGGTAAAGPGDGTEADGRAPPAA ALAGRTTESAAGAAGDSGRAGTAGWGSA ADGRSTGGNAAAEAGAAQSGRAAPRQPS GGTAPESTAPPNSGGSGRADAAPTEEVGV GSGLWRGRYVCGPCGESVPEHPMNPCFG DGTAWICSDDGGSLPAGCYDGGTDGVVC CGVCGGNSCCCGRVECTCGGGAGLLSCC CGSYSWS | | |
| EU403085 | 6620-8593 | gb:EU403085:6620-8593\|Organism:Avian paramyxovirus 3\|Strain Name:APMV3/PKT/Netherland/449/75\|Protein Name:hemagglutinin-neuraminidase protein\|Gene Symbol:HN | MESPPSGKDAPAFREPKRTCRLCYRATTLS LNLTIVVLSIISIYVSTQTGANNSCVNPTIVT PDYLTGSTTGSVEDLADLESQLREIRRDTG INLPVQIDNTENLILTTLASINSNLRFLQNA TTESQTCLSPVNDPRFVAGINRIPAGSMAY NDFSNLIEHVNFIPSPTTLSGCTRIPSFSLSK THWCYTHNVISNGCLDHAASSQYISIGIVD TGLNNEPYFRTMSSKSLNDGLNRKSCSVT AAANACWLLCSVVTEYEAADYRSRTPTA MVLGRFDFNGEYTEIAVPSSLFDGRFASNY PGVGSGTQVNGTLYFPLYGGVLNGSDIET ANKGKSFRPQNPKNRCPDSEAIQSFRAQDS YYPTRFGKVLIQQAIIACRISNKSCTDFYLL YFDNNRVMMGAEARLYYLNNQLYLYQR SSSWWPHPLFYSISLPSCQALAVCQITEAH LTLTYATSRPGMSICTGASRCPNNCVDGV YTDVWPLTKNDAQDPNLFYTVVYLNNSTR RISPTISLYTYDRRIKSKLAVGSDIGAAYTT STCFGRSDTGAVYCLTIMETVNTIFGQYRI VPILLRVTSR | 1 | 752 |
| FJ977568 | 6139-7936 | gb:FJ977568:6139-7936\|Organism:Avian metapneumovirus\|Strain Name:aMPV/MN/turkey/2a/97\|Protein Name:attachment glycoprotein\|Gene Symbol:G | MEVKVENVGKSQELKVKVKNFIKRSDCK KKLFALILGLVSFELTMNIMLSVMYVESNE ALSLCRIQGTPAPRDNKTNTENATKETTLH TTTTTRDPEVRETKTTKPQANEGATNPSR NLTTKGDKHQTTRATTEAELEKQSKQTTE PGTSTQKHTPARPSSKSPTTTQATAQPTTP TAPKASTAPKNRQATTKKTETDTTTASRA RNTNNPTETATTTPKATTETGKGKEGPTQ HTTKEQPETTARETTTPQPRRTASRPAPTT KIEEEAETTKTRTTKNTQTSTGPPRPTRSTP SKTATENNKRTTTTKRPNTASTDSRQQTR TTAEQDQQTQTRAKPTTNGAHPQTTTTPE HNTDTTNSTKGSPKEDKTTRDPSSKTPTEQ EDASKGTAAANPGGSAEADRRAPPATTPT GRTTESAAGTTGDDSGAETTRRRSAADRR PTGGSTAAEAGTAQSGRATPKQPSGGTAA GNTAPPNNESSGRADAAPAEEAGVGPSIR RGRHACGPRRESAPEHPTNPCPGDGTAWT RSDGGGNLPAGRHDSGADGAARRGARGG NPRRRGRAERTRGGGAGPPSCRCGSHNRS | 1 | 753 |
| HG934339 | 5997-7166 | gb:HG934339:5997-7166\|Organism:Avian metapneumovirus type D\|Strain Name:Turkey/1985/Fr85.1\|Protein Name:attachment glycoprotein\|Gene Symbol:G | MGAKLYAISGASDAQLMKKTCAKLLEKV VPIIILAVLGITGTTTIALSISISIERAVLSDCT TQLRNGTTSGSLSNPTRSTTSTAVTTRDIR GLQTTRTRELKSCSNVQIAYGYLHDSSNP VLDSIGCLGLLALCESGPFCQRNYNPRDRP KCRCTLRGKDISCCKEPPTAVTTSKTTPWG TEVHPTYPTQVTPQSQPATMAHQTATANQ RSSTTEPVGSQGNTTSSNPEQQTEPPPSPQH PPTTTSQDQSTETADGQEHTPTRKTPTATS NRRSPTPKRQETGRATPRNTATTQSGSSPP HSSPPGVDANMEGQCKELQAPKPNSVCK | 1 | 754 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | GLDIYREALPRGCDKVLPLCKTSTIMCVDAYYSKPPICFGYNQRCFCMETFGPIEFCCKS | | |
| JN032116 | 4659-5252 | gb:JN032116:4659-5252\|Organism:Respiratory syncytial virus\|Strain Name:B/WI/62 9-12/06-07\|Protein Name:attachment glycoprotein\|Gene Symbol:G | MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSEIHHTTAQTKGRTSTPTQNNKPNTKPRPKNPPKKDDYHFEVFNFVPCSICGNNQLCKSICKTIPSNKPRKNQP | 1 | 755 |
| KX258200 | 6254-7996 | gb:KX258200:6254-7996\|Organism:Avian paramyxovirus 14\|Strain Name:APMV1 4/duck/Japan/110G0352/2011\|Protein Name:hemagglutinin-neuraminidase protein\|Gene Symbol:HN | MEGSRTVIYQGDPNEKNTWRLVFRTLTLILNLAILSVTIASIIITSKITLSEVTTLKTEGVEEVITPLMATLSDSVQQEKMIYKEVAISIPLVLDKIQTDVGTSVAQITDALRQIQGVNGTQAFALSNAPEYSGGIEVPLFQIDSFVNKSMSISGLLEHASFIPSPTTLHGCTRIPSFHLGPRHWCYTHNIIGSRCRDEGFSSMYISIGAITVNRDGNPLFITTASTILADDNNRKSCSIIASSYGCDLLCSIVTESENDDYANPNPTKMVHGRFLYNGSYVEQALPNSLFQDKWVAQYPGVGSGITTHGKVLFPIYGGIKKNTQLFYELSKYGFFAHNKELECKNMTEEQIRDIKAAYLPSKTSGNLFAQGIIYCNISKLGDCNVAVLNTSTTMMGAEGRLQMMGEYVYYYQRSSSWWPVGIVYKKSLAELMNGINMEVLSFEPIPLSKFPRPTWTAGLCQKPSICPDVCVTGVYTDLFSVTIGSTTDKDTYFGVYLDSATERKDPWVAAADQYEWRNRVRLFESTTEAAYTTSTCFKNTVNNRVFCVSIVELRENLLGDWKIVPLLFQIGVSQGPPPK | 1 | 756 |
| KX940961 | 7978-12504 | gb:KX940961:7978-12504\|Organism:Beilong virus\|Strain Name:ERN081008_1S\|Protein Name:attachment glycoprotein\|Gene Symbol:G | MSQLAAHNLAMSNFYGTHQGDLSGSQKGEEQQVQGVIRYVSMIVGLLSLFTIIALNVTNIIYMTESGGTMQSIKTAQGSIDGSMREISGVIMEDVKPKTDLINSMVSYNIPAQLSMIHQIIKNDVLKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDLNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFTGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVSIGRNLTKEGDLTMSAPEDPGSNTFPGGHIPGNGLFDAGYYTVEYPKEWKQTTPKPSEGGNIIDKNKTPVIPSRDNPTSDSSIPHRESIEPVRPTREVLKSSDYVTIVSTDSGSGSGDFATGVPWTGVSPKAPQNGINLPGTELPHPTVLDRINTPAPSDPKVSADSDHTRDTIDPTALSKPLNHDTTGDTDTRINTGTATYGFTPGREATSSGKLANDLTNSTSVPSEAHPSASTSEASKPEKNTDNRVTQDPTSGTAERPTTNAPV | 1 | 757 |

TABLE 5-continued

Paramyxovirus protein G, H, and HN sequence clusters. Column 1, Genbank ID includes the Genbank ID of the whole genome sequence of the virus that is the centroid sequence of the cluster. Column 2, nucleotides of CDS provides the nucleotides corresponding to the CDS of the gene in the whole genome. Column 3, Full Gene Name, provides the full name of the gene including Genbank ID, virus species, strain, and protein name. Column 4, Sequence, provides the amino acid sequence of the gene. Column 5, #Sequences/Cluster, provides the number of sequences that cluster with this centroid sequence.

| Gen bank ID | Nucleotides of CDS | Full sequence ID | #Sequences/ Sequence | Cluster | SEQ ID NO |
|---|---|---|---|---|---|
| | | | DGKHSTQLTDARPNTADPERTSQHSSSTTR DEVKPSLPSTTEASTHQRTEAATPPELVNN TLNPPSTQVRSVRSLMQDAIAQAWNFVRG VTP | | |
| KY511044 | 6454-8310 | gb:KY511044:6454-8310\|Organism:Avian paramyxovirus UPO216\|Strain Name:APMV-15/WB/Kr/UPO216/2014\|Protein Name:hemagglutinin-neuraminidase protein\|Gene Symbol:HN | MERGISEVALANDRTEEKNTWRLIFRITVL VVSVITLGLTAASLVYSMNAAQPADFDGII PAVQQVGTSLTNSIGGMQDVLDRTYKQV ALESPLTLLNMESTIMNAITSLSYKINNGG NSSGCGAPIHDPEYIGGIGKELLIDDNVDV TSFYPSAFKEHLNFIPAPTTGAGCTRIPSFD LSATHYCYTHNVILSGCQDHSHSHQYIAL GVLKLSDTGNVFFSTLRSINLDDTANRKSC SISATPLGCDILCSKVTETELEDYKSEEPTP MVHGRLSFDGTYSEKDLDVNNLFSDWTA NYPSVGGGSYIGNRVWYAVYGGLKPGSN TDQSQRDKYVIYKRYNNTCPDPEDYQINK AKSSYTPSYFGSKRVQQAILSIAVSPTLGSD PVLTPLSNDVVLMGAEGRVMHIGGYTYL YQRGTSYYSPALLYPLNIQDKSATASSPYK FDAFTRPGSVPCQADARCPQSCVTGVYTD PYPLIFAKDHSIRGVYGMMLNDVTARLNPI AAVFSNISRSQITRVSSSSTKAAYTTSTCFK VIKTNRIYCMSIAEISNTLFGEFRIVPLLVEI LSNGGNTARSAGGTPVKESPKGWSDAIAE PLFCTPTNVTRYNADIRRYAYSWP | 1 | 758 |
| NC_025360 | 8127-10158 | gb:NC_025360:8127-10158\|Organism:Atlantic salmon paramyxovirus\|Strain Name:ASPV/Yrkje371/95\|Protein Name:hemagglutinin-neuraminidase protein\|Gene Symbol:HN | MPPAPSPVHDPSSFYGSSLFNEDTASRKGT SEEIHLLGIRWNTVLIVLGLILAIIGIGIGASS FSASGITGNTTKEIRLIVEEMSYGLVRISDS VRQEISPKVTLLQNAVLSSIPALVTTETNTII NAVKNHCNSPPTPPPPTEAPLKKHETGMA PLDPTTYWTCTSGTPRFYSSPNATFIPGPSP LPHTATPGGCVRIPSMHIGSEIYAYTSNLIA SGCQDIGKSYQNVQIGVLDRTPEGNPEMS PMLSHTFPINDNRKSCSIVTLKRAAYIYCS QPKVTEFVDYQTPGIEPMSLDHINANGTTK TWIYSPTEVVTDVPYASMYPSVGSGVVID GKLVFLVYGGLLNGIQVPAMCLSPECPGID QAACNASQYNQYLSGRQVVNGIATVDLM NGQKPHISVETISPSKNWFGAEGRLVYMG GRLYIYIRSTGWHSPIQIGVIYTMNPLAITW VTNTVLSRPGSAGCDWNNRCPKACLSGV YTDAYPISPDYNHLATMILHSTSTRSNPVM VYSSPTNMVNYAQLTTTAQIAGYTTTSCF TDNEVGYCATALELTPGTLSSVQPILVMT KIPKECV | 1 | 759 |

(iii) Other Proteins

In some embodiments, the fusogen may include a pH dependent (e.g., as in cases of ischemic injury) protein, a homologue thereof, a fragment thereof, and a protein fusion comprising one or more proteins or fragments thereof. Fusogens may mediate membrane fusion at the cell surface or in an endosome or in another cell-membrane bound space.

In some embodiments, the fusogen includes a EFF-1, AFF-1, gap junction protein, e.g., a connexin (such as Cn43, GAP43, CX43) (DOI: 10.1021/jacs.6b05191), other tumor connection proteins, a homologue thereof, a fragment thereof, a variant thereof, and a protein fusion comprising one or more proteins or fragments thereof.

Modifications to Protein Fusogens

In some embodiments protein fusogens can be altered to reduce immunoreactivity. For instance, protein fusogens may be decorated with molecules that reduce immune interactions, such as PEG (DOI: 10.1128/JVI.78.2.912-921.2004). Thus, in some embodiments, the fusogen comprises PEG, e.g., is a PEGylated polypeptide. Amino acid residues in the fusogen that are targeted by the immune system may be altered to be unrecognized by the immune system (doi: 10.1016/j.virol.2014.01.027, doi:10.1371/journal.pone.0046667). In some embodiments the protein sequence of the fusogen is altered to resemble amino acid sequences found in humans (humanized). In some embodiments the protein sequence of the fusogen is changed to a protein sequence that binds MHC complexes less strongly. In some embodiments, the protein fusogens are derived from viruses or organisms that do not infect humans (and which humans have not been vaccinated against), increasing the likelihood that a patient's immune system is naïve to the protein fusogens (e.g., there is a negligible humoral or cell-mediated adaptive immune response towards the fusogen) (doi: 10.1006/mthe.2002.0550, doi:10.1371/journal.ppat.1005641, doi:10.1038/gt.2011.209, DOI 10.1182/blood-2014-02-558163). Without wishing to be bound by theory, in some embodiments, a protein fusogen derived from a virus or organism that do not infect humans does not have a natural fusion targets in patients, and thus has high specificity.

Lipid Fusogens

In some embodiments, the fusosome may be treated with fusogenic lipids, such as saturated fatty acids. In some embodiments, the saturated fatty acids have between 10-14 carbons. In some embodiments, the saturated fatty acids have longer-chain carboxylic acids. In some embodiments, the saturated fatty acids are mono-esters.

In some embodiments, the fusosome may be treated with unsaturated fatty acids. In some embodiments, the unsaturated fatty acids have between C16 and C18 unsaturated fatty acids. In some embodiments, the unsaturated fatty acids include oleic acid, glycerol mono-oleate, glycerides, diacylglycerol, modified unsaturated fatty acids, and any combination thereof.

Without wishing to be bound by theory, in some embodiments negative curvature lipids promote membrane fusion. In some embodiments, the fusosome comprises one or more negative curvature lipids, e.g., negative curvature lipids that are exogenous relative to the source cell, in the membrane. In embodiments, the negative curvature lipid or a precursor thereof is added to media comprising source cells or fusosomes. In embodiments, the source cell is engineered to express or overexpress one or more lipid synthesis genes. The negative curvature lipid can be, e.g., diacylglycerol (DAG), cholesterol, phosphatidic acid (PA), phosphatidylethanolamine (PE), or fatty acid (FA).

Without wishing to be bound by theory, in some embodiments positive curvature lipids inhibit membrane fusion. In some embodiments, the fusosome comprises reduced levels of one or more positive curvature lipids, e.g., exogenous positive curvature lipids, in the membrane. In embodiments, the levels are reduced by inhibiting synthesis of the lipid, e.g., by knockout or knockdown of a lipid synthesis gene, in the source cell. The positive curvature lipid can be, e.g., lysophosphatidylcholine (LPC), phosphatidylinositol (PtdIns), lysophosphatidic acid (LPA), lysophosphatidylethanolamine (LPE), or monoacylglycerol (MAG).

Chemical Fusogens

In some embodiments, the fusosome may be treated with fusogenic chemicals. In some embodiments, the fusogenic chemical is polyethylene glycol (PEG) or derivatives thereof.

In some embodiments, the chemical fusogen induces a local dehydration between the two membranes that leads to unfavorable molecular packing of the bilayer. In some embodiments, the chemical fusogen induces dehydration of an area near the lipid bilayer, causing displacement of aqueous molecules between cells and allowing interaction between the two membranes together.

In some embodiments, the chemical fusogen is a positive cation. Some nonlimiting examples of positive cations include $Ca^{2+}$, $Mg^{2+}$, $Mn^{2+}$, $Zn^{2+}$, $La^{3+}$, $Sr^{3+}$, and $H^+$.

In some embodiments, the chemical fusogen binds to the target membrane by modifying surface polarity, which alters the hydration-dependent intermembrane repulsion.

In some embodiments, the chemical fusogen is a soluble lipid soluble. Some nonlimiting examples include oleoylglycerol, dioleoylglycerol, trioleoylglycerol, and variants and derivatives thereof.

In some embodiments, the chemical fusogen is a water-soluble chemical. Some nonlimiting examples include polyethylene glycol, dimethyl sulphoxide, and variants and derivatives thereof.

In some embodiments, the chemical fusogen is a small organic molecule. A nonlimiting example includes n-hexyl bromide.

In some embodiments, the chemical fusogen does not alter the constitution, cell viability, or the ion transport properties of the fusogen or target membrane.

In some embodiments, the chemical fusogen is a hormone or a vitamin. Some nonlimiting examples include abscisic acid, retinol (vitamin A1), a tocopherol (vitamin E), and variants and derivatives thereof.

In some embodiments, the fusosome comprises actin and an agent that stabilizes polymerized actin. Without wishing to be bound by theory, stabilized actin in a fusosome can promote fusion with a target cell. In embodiments, the agent that stabilizes polymerized actin is chosen from actin, myosin, biotin-streptavidin, ATP, neuronal Wiskott-Aldrich syndrome protein (N-WASP), or formin See, e.g., Langmuir. 2011 Aug. 16; 27(16):10061-71 and Wen et al., Nat Commun. 2016 Aug. 31; 7. In embodiments, the fusosome comprises actin that is exogenous or overexpressed relative to the source cell, e.g., wild-type actin or actin comprising a mutation that promotes polymerization. In embodiments, the fusosome comprises ATP or phosphocreatine, e.g., exogenous ATP or phosphocreatine.

Small Molecule Fusogens

In some embodiments, the fusosome may be treated with fusogenic small molecules. Some nonlimiting examples include halothane, nonsteroidal anti-inflammatory drugs (NSAIDs) such as meloxicam, piroxicam, tenoxicam, and chlorpromazine.

In some embodiments, the small molecule fusogen may be present in micelle-like aggregates or free of aggregates.

Fusogen Modifications

In some embodiments, the fusogen is linked to a cleavable protein. In some cases, a cleavable protein may be cleaved by exposure to a protease. An engineered fusion protein may bind any domain of a transmembrane protein. The engineered fusion protein may be linked by a cleavage peptide to a protein domain located within the intermembrane space. The cleavage peptide may be cleaved by one or a combination of intermembrane proteases (e.g. HTRA2/OMI which requires a non-polar aliphatic amino acid—valine, isoleucine or methionine are preferred—at position P1, and hydrophilic residues—arginine is preferred—at the P2 and P3 positions).

In some embodiments, fusogen proteins are engineered by any methods known in the art or any method described herein to comprise a proteolytic degradation sequence, e.g., a mitochondrial or cytosolic degradation sequence. Fusogen proteins may be engineered to include, but is not limited to a proteolytic degradation sequence, e.g., a Caspase 2 protein sequence (e.g., Val-Asp-Val-Ala-Asp-|-)(SEQ ID NO: 604) or other proteolytic sequences (see, for example, Gasteiger et al., The Proteomics Protocols Handbook; 2005: 571-607), a modified proteolytic degradation sequence that has at least 75%, 80%, 85%, 90%, 95% or greater identity to the wildtype proteolytic degradation sequence, a cytosolic proteolytic degradation sequence, e.g., ubiquitin, or a modified cytosolic proteolytic degradation sequence that has at least 75%, 80%, 85%, 90%, 95% or greater identity to the wildtype proteolytic degradation sequence. In some embodiments, a composition comprises mitochondria in a source cell or chondrisome comprising a protein modified with a proteolytic degradation sequence, e.g., at least 75%, 80%, 85%, 90%, 95% or greater identity to the wildtype proteolytic degradation sequence, a cytosolic proteolytic degradation sequence, e.g., ubiquitin, or a modified cytosolic proteolytic degradation sequence that has at least 75%, 80%, 85%, 90%, 95% or greater identity to the wildtype proteolytic degradation sequence.

In some embodiments, the fusogen may be modified with a protease domain that recognizes specific proteins, e.g., over-expression of a protease, e.g., an engineered fusion protein with protease activity. For example, a protease or protease domain from a protease, such as MMP, mitochondrial processing peptidase, mitochondrial intermediate peptidase, inner membrane peptidase.

See, Alfonzo, J. D. & Soll, D. Mitochondrial tRNA import—the challenge to understand has just begun. Biological Chemistry 390: 717-722. 2009; Langer, T. et al. Characterization of Peptides Released from Mitochondria. THE JOURNAL OF BIOLOGICAL CHEMISTRY. Vol. 280, No. 4. 2691-2699, 2005; Vliegh, P. et al. Synthetic therapeutic peptides: science and market. Drug Discovery Today. 15(1/2). 2010; Quiros P. M. m et al., New roles for mitochondrial proteases in health, ageing and disease. Nature Reviews Molecular Cell Biology. V16, 2015; Weber-Lotfi, F. et al. DNA import competence and mitochondrial genetics. Biopolymers and Cell. Vol. 30. N 1. 71-73, 2014.

Non-Endocytyic Entry into Target Cells

In some embodiments, a fusosome or fusosome composition described herein delivers a cargo to a target cell via a non-endocytic pathway. Without wishing to be bound by theory, a non-endocytic delivery route can improve the amount or percentage of cargo delivered to the cell, e.g., to the desired compartment of the cell.

Accordingly, in some embodiments, a plurality of fusosomes described herein, when contacted with a target cell population in the presence of an inhibitor of endocytosis, and when contacted with a reference target cell population not treated with the inhibitor of endocytosis, delivers the cargo to at least 30%, 40%, 50%, 60%, 70%, or 80% of the number of cells in the target cell population compared to the reference target cell population.

In some embodiments, less than 10% of cargo enters the cell by endocytosis.

In some embodiments, the inhibitor of endocytosis is an inhibitor of lysosomal acidification, e.g., bafilomycin A1.

In some embodiments, cargo delivered is determined using an endocytosis inhibition assay, e.g., an assay of Example 125.

In some embodiments, cargo enters the cell through a dynamin-independent pathway or a lysosomal acidification-independent pathway, a macropinocytosis-independent pathway, or an actin-independent pathway.

In some embodiments (e.g., embodiments for assaying non-endocytic delivery of cargo) cargo delivery is assayed using one or more of (e.g., all of) the following steps: (a) placing 30,000 HEK-293T target cells into a first well of a 96-well plate comprising 100 nM bafilomycin A1, and placing a similar number of similar cells into a second well of a 96-well plate lacking bafilomycin A1, (b) culturing the target cells for four hours in DMEM media at 37° C. and 5% $CO_2$, (c) contacting the target cells with 10 ug of fusosomes that comprise cargo, (d) incubating the target cells and fusosomes for 24 hrs at 37° C. and 5% CO2, and (e) determining the percentage of cells in the first well and in the second well that comprise the cargo. Step (e) may comprise detecting the cargo using microscopy, e.g., using immunofluorescence. Step (e) may comprise detecting the cargo indirectly, e.g., detecting a downstream effect of the cargo, e.g., presence of a reporter protein. In some embodiments, one or more of steps (a)-(e) above is performed as described in Example 125.

In some embodiments, an inhibitor of endocytosis (e.g., chloroquine or bafilomycin A1) inhibits endosomal acidification. In some embodiments, cargo delivery is independent of lysosomal acidification. In some embodiments, an inhibitor of endocytosis (e.g., Dynasore) inhibits dynamin. In some embodiments, cargo delivery is independent of dynamin activity.

In some embodiments, the fusosome enters the target cell by endocytosis, e.g., wherein the level of therapeutic agent delivered via an endocytic pathway is 0.01-0.6, 0.01-0.1, 0.1-0.3, or 0.3-0.6, or at least 1%, 2%, 3%, 4%, 5%, 10%, 20%, 30%, 40%, 50%, 60%, 70%, 80%, 90% or greater than a chloroquine treated reference cell contacted with similar fusosomes, e.g., using an assay of Example 91. In some embodiments, at least 1%, 2%, 3%, 4%, 5%, 10%, 20%, 30%, 40%, 50%, 60%, 70%, 80%, 90% of fusosomes in a fusosome composition that enter a target cell enter via a non-endocytic pathway, e.g., the fusosomes enter the target cell via fusion with the cell surface. In some embodiments, the level of a therapeutic agent delivered via a non-endocytic pathway for a given fusosome is 0.1-0.95, 0.1-0.2, 0.2-0.3, 0.3-0.4, 0.4-0.5, 0.5-0.6, 0.6-0.7, 0.7-0.8, 0.8-0.9, 0.9-0.95, or at least at least 1%, 2%, 3%, 4%, 5%, 10%, 20%, 30%, 40%, 50%, 60%, 70%, 80%, 90% or greater than a chloroquine treated reference cell, e.g., using an assay of Example 90. In some embodiments, at least 1%, 2%, 3%, 4%, 5%, 10%, 20%, 30%, 40%, 50%, 60%, 70%, 80%, 90% of fusosomes in a fusosome composition that enter a target cell enter the cytoplasm (e.g., do not enter an endosome or lysosome). In some embodiments, less than 90%, 80%, 70%, 60%, 50%, 40%, 30%, 20%, 10%, 5%, 4%, 3%, 2%, or 1% of fusosomes in a fusosome composition that enter a target cell enter an endosome or lysosome. In some embodiments, the fusosome enters the target cell by a non-endocytic pathway, e.g., wherein the level of therapeutic agent delivered is at least 90%, 95%, 98%, or 99% that of a chloroquine treated reference cell, e.g., using an assay of Example 91. In an embodiment, a fusosome delivers an agent to a target cell via a dynamin mediated pathway. In an embodiment, the level of agent delivered via a dynamin mediated pathway is in the range of 0.01-0.6, or at least 1%, 2%, 3%, 4%, 5%, 10%, 20%, 30%, 40%, 50%, 60%, 70%, 80%, 90% or greater than Dynasore treated target cells contacted with similar fusosomes, e.g., as measured in an assay of Example 92. In an embodiment, a fusosome delivers an agent to a target cell via macropinocytosis. In an embodiment, the level of agent delivered via macropinocytosis is in the range of 0.01-0.6, or at least 1%, 2%, 3%, 4%, 5%, 10%, 20%, 30%, 40%, 50%, 60%, 70%, 80%, 90% or greater than EIPA treated target cells contacted with similar fusosomes, e.g., as measured in an assay of Example 92. In an embodiment, a fusosome delivers an agent to a target cell via an actin-mediated pathway. In an embodiment, the level of agent delivered via an actin-mediated pathway will be in the range of 0.01-0.6, or at least 1%, 2%, 3%, 4%, 5%, 10%, 20%, 30%, 40%, 50%, 60%, 70%, 80%, 90% or greater than Latrunculin B treated target cells contacted with similar fusosomes, e.g., as measured in an assay of Example 92.

In some embodiments, the cargo delivered to the target cell is determined using an endocytosis inhibition assay, e.g., an assay of Example 90, 92, or 125.

In some embodiments, cargo enters the target cell through a dynamin-independent pathway or a lysosomal acidification-independent pathway, a macropinocytosis-independent pathway (e.g., wherein the inhibitor of endocytosis is an inhibitor of macropinocytosis, e.g., 5-(N-ethyl-N-isopropyl) amiloride (EIPA), e.g., at a concentration of 25 μM), or an actin-independent pathway (e.g., wherein the inhibitor of endocytosis is an inhibitor of actin polymerization is, e.g., Latrunculin B, e.g., at a concentration of 6 μM).

In some embodiments, the fusosome, when contacted with a target cell population, delivers cargo to a target cell location other than an endosome or lysosome, e.g., to the cytosol, an organelle, or the cell membrane. In embodiments, less 50%, 40%, 30%, 20%, or 10% of the cargo is delivered to an endosome or lysosome.

Specific Delivery to Target Cells

In some embodiments, a fusosome composition described herein delivers cargo preferentially to a target cell compared to a non-target cell. Accordingly, in certain embodiments, a fusosome described herein has one or both of the following properties: (i) when the plurality of fusosomes are contacted with a cell population comprising target cells and non-target cells, the cargo is present in at least 2-fold, 5-fold, 10-fold, 20-fold, 50-fold, or 100-fold more target cells than non-target cells, or (ii) the fusosomes of the plurality fuse at a higher rate with a target cell than with a non-target cell by at least at least 50%.

In some embodiments, presence of cargo is measured by microscopy, e.g., using an assay of Example 126. In some embodiments, fusion is measured by microscopy, e.g., using an assay of Example 54. In some embodiments, the targeting moiety is specific for a cell surface marker on the target cell. In some embodiments, the cell surface marker is a cell surface marker of a skin cell, cardiomyocyte, hepatocyte, intestinal cell (e.g., cell of the small intestine), pancreatic cell, brain cell, prostate cell, lung cell, colon cell, or bone marrow cell.

In some embodiments (e.g., embodiments for specific delivery of cargo to a target cell versus a non-target cell), cargo delivery is assayed using one or more of (e.g., all of) the following steps: (a) placing 30,000 HEK-293T target cells that over-express CD8a and CD8b into a first well of a 96-well plate and placing 30,000 HEK-293T non-target cells that do not over-express CD8a and CD8b into a second well of a 96-well plate, (b) culturing the cells for four hours in DMEM media at 37° C. and 5% $CO_2$, (c) contacting the target cells with 10 ug of fusosomes that comprise cargo, (d) incubating the target cells and fusosomes for 24 hrs at 37° C. and 5% $CO_2$, and (e) determining the percentage of cells in the first well and in the second well that comprise the cargo. Step (e) may comprise detecting the cargo using microscopy, e.g., using immunofluorescence. Step (e) may comprise detecting the cargo indirectly, e.g., detecting a downstream effect of the cargo, e.g., presence of a reporter protein. In some embodiments, one or more of steps (a)-(e) above is performed as described in Example 126.

In some embodiments, the fusosome fuses at a higher rate with a target cell than with a non-target cell, e.g., by at least at least 1%, 2%, 3%, 4%, 5%, 10%, 20%, 30%, 40%, 50%, 60%, 70%, 80%, 90%, 2-fold, 3-fold, 4-fold, 5-fold, 10-fold, 20-fold, 50-fold, or 100-fold, e.g., in an assay of Example 54. In some embodiments, the fusosome fuses at a higher rate with a target cell than with other fusosomes, e.g., by at least 10%, 20%, 30%, 40%, 50%, 60%, 70%, 80%, or 90%, e.g., in an assay of Example 54. In some embodiments, the fusosome fuses with target cells at a rate such that an agent in the fusosome is delivered to at least 10%, 20%, 30%, 40%, 50%, 60%, 70%, 80%, or 90%, of target cells after 24, 48, or 72 hours, e.g., in an assay of Example 54. In embodiments, the amount of targeted fusion is about 30%-70%, 35%-65%, 40%-60%, 45%-55%, or 45%-50%, e.g., about 48.8% e.g., in an assay of Example 54. In embodiments, the amount of targeted fusion is about 20%-40%, 25%-35%, or 30%-35%, e.g., about 32.2% e.g., in an assay of Example 55.

In some embodiments, the fusosome composition delivers at least 40%, 45%, 50%, 55%, 60%, 65%, 70%, 75%, 80%, 85%, 90%, 95%, 96%, 97%, 98%, or 99% of the cargo to the target cell population compared to the reference target cell population or to a non-target cell population. In some embodiments, the fusosome composition delivers at least 40%, 45%, 50%, 55%, 60%, 65%, 70%, 75%, 80%, 85%, 90%, 95%, 96%, 97%, 98%, or 99% more of the cargo to the target cell population compared to the reference target cell population or to a non-target cell population.

Fusosome Generation

Fusosomes Generated from Cells

Compositions of fusosomes may be generated from cells in culture, for example cultured mammalian cells, e.g., cultured human cells. The cells may be progenitor cells or non-progenitor (e.g., differentiated) cells. The cells may be primary cells or cell lines (e.g., a mammalian, e.g., human, cell line described herein). In embodiments, the cultured cells are progenitor cells, e.g., bone marrow stromal cells, marrow derived adult progenitor cells (MAPCs), endothelial progenitor cells (EPC), blast cells, intermediate progenitor cells formed in the subventricular zone, neural stem cells, muscle stem cells, satellite cells, liver stem cells, hematopoietic stem cells, bone marrow stromal cells, epidermal stem cells, embryonic stem cells, mesenchymal stem cells, umbilical cord stem cells, precursor cells, muscle precursor cells, myoblast, cardiomyoblast, neural precursor cells, glial precursor cells, neuronal precursor cells, hepatoblasts.

In some embodiments, the source cell is an endothelial cell, a fibroblast, a blood cell (e.g., a macrophage, a neutrophil, a granulocyte, a leukocyte), a stem cell (e.g., a mesenchymal stem cell, an umbilical cord stem cell, bone marrow stem cell, a hematopoietic stem cell, an induced pluripotent stem cell e.g., an induced pluripotent stem cell derived from a subject's cells), an embryonic stem cell (e.g., a stem cell from embryonic yolk sac, placenta, umbilical cord, fetal skin, adolescent skin, blood, bone marrow, adipose tissue, erythropoietic tissue, hematopoietic tissue), a myoblast, a parenchymal cell (e.g., hepatocyte), an alveolar cell, a neuron (e.g., a retinal neuronal cell) a precursor cell (e.g., a retinal precursor cell, a myeloblast, myeloid precursor cells, a thymocyte, a meiocyte, a megakaryoblast, a promegakaryoblast, a melanoblast, a lymphoblast, a bone marrow precursor cell, a normoblast, or an angioblast), a progenitor cell (e.g., a cardiac progenitor cell, a satellite cell, a radial gial cell, a bone marrow stromal cell, a pancreatic progenitor cell, an endothelial progenitor cell, a blast cell), or an immortalized cell (e.g., HeLa, HEK293, HFF-1, MRC-5, WI-38, IMR 90, IMR 91, PER.C6, HT-1080, or BJ cell).

The cultured cells may be from epithelial, connective, muscular, or nervous tissue or cells, and combinations thereof. Fusosome can be generated from cultured cells from any eukaryotic (e.g., mammalian) organ system, for example, from the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves); reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof. In embodiments, the cells are from a highly mitotic tissue (e.g., a highly mitotic healthy tissue, such as epithelium, embryonic tissue, bone marrow, intestinal crypts). In embodiments, the tissue sample is a highly metabolic tissue (e.g., skeletal tissue, neural tissue, cardiomyocytes).

In some embodiments a cell is a suspension cell. In some embodiments a cell is an adherent cell.

In some embodiments, the cells are from a young donor, e.g., a donor 25 years, 20 years, 18 years, 16 years, 12 years, 10 years, 8 years of age, 5 years of age, 1 year of age, or less. In some embodiments, the cells are from fetal tissue.

In some embodiments, the cells are derived from a subject and administered to the same subject or a subject with a similar genetic signature (e.g., MHC-matched).

In certain embodiments, the cells have telomeres of average size greater than 3000, 4000, 5000, 6000, 7000, 8000, 9000, or 10000 nucleotides in length (e.g., between 4,000-10,000 nucleotides in length, between 6,000-10,000 nucleotides in length).

Fusosomes may be generated from cells generally cultured according to methods known in the art. In some embodiments, the cells may be cultured in 2 or more "phases", e.g., a growth phase, wherein the cells are cultured under conditions to multiply and increase biomass of the culture, and a "production" phase, wherein the cells are cultured under conditions to alter cell phenotype (e.g., to maximize mitochondrial phenotype, to increase number or diameter of mitochondria, to increase oxidative phosphorylation status). There may also be an "expression" phase, wherein the cells are cultured under conditions to maximize expression of protein fusogens or agents exogenous relative to the source cell, on the cell membrane and to restrict unwanted fusion in other phases.

In some embodiments, fusosomes are generated from cells synchronized, e.g., during a growth phase or the production phase. For example, cells may be synchronized at G1 phase by elimination of serum from the culture medium (e.g., for about 12-24 hours) or by the use in the culture media of DNA synthesis inhibitors such as thymidine, aminopterin, hydroxyurea and cytosine arabinoside. Additional methods for mammalian cell cycle synchronization are known and disclosed, e.g., in Rosner et al. 2013. Nature Protocols 8:602-626 (specifically Table 1 in Rosner).

In some embodiments, the cells can be evaluated and optionally enriched for a desirable phenotype or genotype for use as a source for fusosome composition as described herein. For example, cells can be evaluated and optionally enriched, e.g., before culturing, during culturing (e.g., during a growth phase or a production phase) or after culturing but before fusosome production, for example, for one or more of: membrane potential (e.g., a membrane potential of −5 to −200 mV; cardiolipin content (e.g., between 1-20% of total lipid); cholesterol, phosphatidylethanolamine (PE), diglyceride (DAG), phosphatidic acid (PA), or fatty acid (FA) content; genetic quality >80%, >85%, >90%; fusogen expression or content; cargo expression or content.

In some embodiments, fusosomes are generated from a cell clone identified, chosen, or selected based on a desirable phenotype or genotype for use as a source for fusosome composition described herein. For example, a cell clone is identified, chosen, or selected based on low mitochondrial mutation load, long telomere length, differentiation state, or a particular genetic signature (e.g., a genetic signature to match a recipient).

A fusosome composition described herein may be comprised of fusosomes from one cellular or tissue source, or from a combination of sources. For example, a fusosome composition may comprise fusosomes from xenogeneic sources (e.g., animals, tissue culture of the aforementioned species' cells), allogeneic, autologous, from specific tissues resulting in different protein concentrations and distributions (liver, skeletal, neural, adipose, etc.), from cells of different metabolic states (e.g., glycolytic, respiring). A composition may also comprise fusosomes in different metabolic states, e.g. coupled or uncoupled, as described elsewhere herein.

In some embodiments, fusosomes are generated from source cells expressing a fusogen, e.g., a fusogen described herein. In some embodiments, the fusogen is disposed in a membrane of the source cell, e.g., a lipid bilayer membrane, e.g., a cell surface membrane, or a subcellular membrane (e.g., lysosomal membrane). In some embodiments, fusosomes are generated from source cells with a fusogen disposed in a cell surface membrane.

In some embodiments, fusosomes are generated by inducing budding of an exosome, microvesicle, membrane vesicle, extracellular membrane vesicle, plasma membrane vesicle, giant plasma membrane vesicle, apoptotic body, mitoparticle, pyrenocyte, lysosome, or other membrane enclosed vesicle.

In some embodiments, fusosomes are generated by inducing cell enucleation. Enucleation may be performed using assays such as genetic, chemical (e.g., using Actinomycin D, see Bayona-Bafaluy et al., "A chemical enucleation method for the transfer of mitochondrial DNA to ρ° cells" Nucleic Acids Res. 2003 Aug. 15; 31(16): e98), mechanical methods (e.g., squeezing or aspiration, see Lee et al., "A comparative study on the efficiency of two enucleation methods in pig somatic cell nuclear transfer: effects of the squeezing and the aspiration methods." Anim Biotechnol. 2008; 19(2):71-9), or combinations thereof. Enucleation refers not only to a complete removal of the nucleus but also the displacement of the nucleus from its typical location such that the cell contains the nucleus but it is non-functional.

In embodiments, making a fusosome comprises producing cell ghosts, giant plasma membrane vesicle, or apoptotic bodies. In embodiments, a fusosome composition comprises one or more of cell ghosts, giant plasma membrane vesicle, and apoptotic bodies.

In some embodiments, fusosomes are generated by inducing cell fragmentation. In some embodiments, cell fragmentation can be performed using the following methods, including, but not limited to: chemical methods, mechanical methods (e.g., centrifugation (e.g., ultracentrifugation, or density centrifugation), freeze-thaw, or sonication), or combinations thereof.

In some embodiments, a fusosome can be generated from a source cell expressing a fusogen, e.g., as described herein, by any one, all of, or a combination of the following methods:

i) inducing budding of a mitoparticle, exosome, or other membrane enclosed vesicle;
ii) inducing nuclear inactivation, e.g., enucleation, by any of the following methods or a combination thereof:

a) a genetic method;

b) a chemical method, e.g., using Actinomycin D; or c) a mechanical method, e.g., squeezing or aspiration; or iii) inducing cell fragmentation, e.g., by any of the following methods or a combination thereof:

a) a chemical method;

b) a mechanical method, e.g., centrifugation (e.g., ultracentrifugation or density centrifugation); freeze thaw; or sonication.

For avoidance of doubt, it is understood that in many cases the source cell actually used to make the fusosome will not be available for testing after the fusosome is made. Thus, a comparison between a source cell and a fusosome does not need to assay the source cell that was actually modified (e.g., enucleated) to make the fusosome. Rather, cells otherwise similar to the source cell, e.g., from the same culture, the same genotype same tissue type, or any combination thereof, can be assayed instead.

Modifications to Cells Prior to Fusosome Generation

In some aspects, a modification is made to a cell, such as modification of a subject, tissue or cell, prior to fusosome generation. Such modifications can be effective to, e.g., improve fusion, fusogen expression or activity, structure or function of the cargo, or structure or function of the target cell.

(i) Physical Modifications

In some embodiments, a cell is physically modified prior to generating the fusosome. For example, as described elsewhere herein, a fusogen may be linked to the surface of the cell.

In some embodiments, a cell is treated with a chemical agent prior to generating the fusosome. For example, the cell may be treated with a chemical or lipid fusogen, such that the chemical or lipid fusogen non-covalently or covalently interacts with the surface of the cell or embeds within the surface of the cell. In some embodiments, the cell is treated with an agent to enhance fusogenic properties of the lipids in the cell membrane.

In some embodiments, the cell is physically modified prior to generating the fusosome with one or more covalent or non-covalent attachment sites for synthetic or endogenous small molecules or lipids on the cell surface that enhance targeting of the fusosome to an organ, tissues, or cell-type.

In embodiments, a fusosome comprises increased or decreased levels of an endogenous molecule. For instance, the fusosome may comprise an endogenous molecule that also naturally occurs in the naturally occurring source cell but at a higher or lower level than in the fusosome. In some embodiments, the polypeptide is expressed from an exogenous nucleic acid in the source cell or fusosome. In some embodiments, the polypeptide is isolated from a source and loaded into or conjugated to a source cell or fusosome.

In some embodiments, a cell is treated with a chemical agent, e.g., small molecule, prior to generating the fusosome to increase the expression or activity of an endogenous fusogen in the cell (e.g., in some embodiments, endogenous relative to the source cell, and in some embodiments, endogenous relative to the target cell). In some embodiments, a small molecule may increase expression or activity of a transcriptional activator of the endogenous fusogen. In some embodiments, a small molecule may decrease expression or activity of a transcriptional repressor of the endogenous fusogen. In some embodiments, a small molecule is an epigenetic modifier that increases expression of the endogenous fusogen.

In some embodiments, fusosomes are generated from cells treated with fusion arresting compounds, e.g., lysophosphatidylcholine. In some embodiments, fusosomes are generated from cells treated with dissociation reagents that do not cleave fusogens, e.g., Accutase.

In some embodiments, a source cell is physically modified with, e.g., CRISPR activators, prior to generating a fusosome to add or increase the concentration of fusogens.

In some embodiments, the cell is physically modified to increase or decrease the quantity, or enhance the structure or function of organelles, e.g., mitochondria, Golgi apparatus, endoplasmic reticulum, intracellular vesicles (such as lysosomes, autophagosomes).

(ii) Genetic Modifications

In some embodiments, a cell is genetically modified prior to generating the fusosome to increase the expression of an endogenous fusogen in the cell (e.g., in some embodiments, endogenous relative to the source cell, and in some embodiments, endogenous relative to the target cell. In some embodiments, a genetic modification may increase expression or activity of a transcriptional activator of the endogenous fusogen. In some embodiments, a genetic modification may decrease expression or activity of a transcriptional repressor of the endogenous fusogen. In some embodiments the activator or repressor is a nuclease-inactive cas9 (dCas9) linked to a transcriptional activator or repressor that is targeted to the endogenous fusogen by a guide RNA. In some embodiments, a genetic modification epigenetically modifies an endogenous fusogen gene to increase its expression. In some embodiments the epigenetic activator a nuclease-inactive cas9 (dCas9) linked to an epigenetic modifier that is targeted to the endogenous fusogen by a guide RNA.

In some embodiments, a cell is genetically modified prior to generating the fusosome to increase the expression of an exogenous fusogen in the cell, e.g., delivery of a transgene. In some embodiments, a nucleic acid, e.g., DNA, mRNA or siRNA, is transferred to the cell prior to generating the fusosome, e.g., to increase or decrease the expression of a cell surface molecule (protein, glycan, lipid or low molecular weight molecule) used for organ, tissue, or cell targeting. In some embodiments, the nucleic acid targets a repressor of a fusogen, e.g., an shRNA, siRNA construct. In some embodiments, the nucleic acid encodes an inhibitor of a fusogen repressor.

In some embodiments, the method comprises introducing a nucleic acid, that is exogenous relative to the source cell encoding a fusogen into a source cell. The exogenous nucleic acid may be, e.g., DNA or RNA. In some embodiments the exogenous nucleic acid may be e.g., a DNA, a gDNA, a cDNA, an RNA, a pre-mRNA, an mRNA, an miRNA, an siRNA, etc. In some embodiments, the exogenous DNA may be linear DNA, circular DNA, or an artificial chromosome. In some embodiments the DNA is maintained episomally. In some embodiments the DNA is integrated into the genome. The exogenous RNA may be chemically modified RNA, e.g., may comprise one or more backbone modification, sugar modifications, noncanonical bases, or caps. Backbone modifications include, e.g., phosphorothioate, N3' phosphoramidite, boranophosphate, phosphonoacetate, thio-PACE, morpholino phosphoramidites, or PNA. Sugar modifications include, e.g., 2'-O-Me, 2'F, 2'F-ANA, LNA, UNA, and 2'-O-MOE. Noncanonical bases include, e.g., 5-bromo-U, and 5-iodo-U, 2,6-diaminopurine, C-5 propynyl pyrimidine, difluorotoluene, difluorobenzene, dichlorobenzene, 2-thiouridine, pseudouridine, and dihydrouridine. Caps include, e.g., ARCA. Additional modifications are discussed, e.g., in Deleavey et al., "Designing Chemically Modified Oligonucleotides for Targeted Gene Silencing" Chemistry & Biology Volume 19, Issue 8, 24 Aug. 2012, Pages 937-954, which is herein incorporated by reference in its entirety.

In some embodiments, a cell is treated with a chemical agent, e.g. a small molecule, prior to generating the fusosome to increase the expression or activity of a fusogen that is exogenous relative to the source cell in the cell. In some embodiments, a small molecule may increase expression or activity of a transcriptional activator of the exogenous fusogen. In some embodiments, a small molecule may decrease expression or activity of a transcriptional repressor of the exogenous fusogen. In some embodiments, a small molecule is an epigenetic modifier that increases expression of the exogenous fusogen.

In some embodiments, the nucleic acid encodes a modified fusogen. For example, a fusogen that has regulatable fusogenic activity, e.g., specific cell-type, tissue-type or local microenvironment activity. Such regulatable fusogenic activity may include, activation and/or initiation of fusogenic activity by low pH, high pH, heat, infrared light, extracellular enzyme activity (eukaryotic or prokaryotic), or exposure of a small molecule, a protein, or a lipid. In some embodiments, the small molecule, protein, or lipid is displayed on a target cell.

In some embodiments, a cell is genetically modified prior to generating the fusosome to alter (i.e., upregulate or downregulate) the expression of signaling pathways (e.g., the Wnt/Beta-catenin pathway). In some embodiments, a cell is genetically modified prior to generating the fusosome to alter (e.g., upregulate or downregulate) the expression of a gene or genes of interest. In some embodiments, a cell is genetically modified prior to generating the fusosome to alter (e.g., upregulate or downregulate) the expression of a nucleic acid (e.g. a miRNA or mRNA) or nucleic acids of interest. In some embodiments, nucleic acids, e.g., DNA, mRNA or siRNA, are transferred to the cell prior to generating the fusosome, e.g., to increase or decrease the expression of signaling pathways, genes, or nucleic acids. In some embodiments, the nucleic acid targets a repressor of a signaling pathway, gene, or nucleic acid, or represses a signaling pathway, gene, or nucleic acid. In some embodiments, the nucleic acid encodes a transcription factor that upregulates or downregulates a signaling pathway, gene, or nucleic acid. In some embodiments the activator or repressor is a nuclease-inactive cas9 (dCas9) linked to a transcriptional activator or repressor that is targeted to the signaling pathway, gene, or nucleic acid by a guide RNA. In some embodiments, a genetic modification epigenetically modifies an endogenous signaling pathway, gene, or nucleic acid to its expression. In some embodiments the epigenetic activator a nuclease-inactive cas9 (dCas9) linked to a epigenetic modifier that is targeted to the signaling pathway, gene, or nucleic acid by a guide RNA. In some embodiments, a cell's DNA is edited prior to generating the fusosome to alter (e.g., upregulate or downregulate) the expression of signaling pathways (e.g. the Wnt/Beta-catenin pathway), gene, or nucleic acid. In some embodiments, the DNA is edited using a guide RNA and CRISPR-Cas9/Cpf1 or other gene editing technology.

A cell may be genetically modified using recombinant methods. A nucleic acid sequence coding for a desired gene can be obtained using recombinant methods, such as, for example by screening libraries from cells expressing the gene, by deriving the gene from a vector known to include the same, or by isolating directly from cells and tissues containing the same, using standard techniques. Alternatively, a gene of interest can be produced synthetically, rather than cloned.

Expression of natural or synthetic nucleic acids is typically achieved by operably linking a nucleic acid encoding the gene of interest to a promoter, and incorporating the construct into an expression vector. The vectors can be suitable for replication and integration in eukaryotes. Typical cloning vectors contain transcription and translation terminators, initiation sequences, and promoters useful for expression of the desired nucleic acid sequence.

In some embodiments, a cell may be genetically modified with one or more expression regions, e.g., a gene. In some embodiments, the cell may be genetically modified with an exogenous gene (e.g., capable of expressing an exogenous gene product such as an RNA or a polypeptide product) and/or an exogenous regulatory nucleic acid. In some embodiments, the cell may be genetically modified with an exogenous sequence encoding a gene product that is endogenous to a target cell and/or an exogenous regulatory nucleic acid capable of modulating expression of an endogenous gene. In some embodiments, the cell may be genetically modified with an exogenous gene and/or a regulatory nucleic acid that modulates expression of an exogenous gene. In some embodiments, the cell may be genetically modified with an exogenous gene and/or a regulatory nucleic acid that modulates expression of an endogenous gene. It will be understood by one of skill in the art that the cell described herein may be genetically modified to express a variety of exogenous genes that encode proteins or regulatory molecules, which may, e.g., act on a gene product of the endogenous or exogenous genome of a target cell. In some embodiments, such genes confer characteristics to the fusosome, e.g., modulate fusion with a target cell. In some embodiments, the cell may be genetically modified to express an endogenous gene and/or regulatory nucleic acid. In some embodiments, the endogenous gene or regulatory nucleic acid modulates the expression of other endogenous genes. In some embodiments, the cell may be genetically modified to express an endogenous gene and/or regulatory nucleic acid which is expressed differently (e.g., inducibly, tissue-specifically, constitutively, or at a higher or lower level) than a version of the endogenous gene and/or regulatory nucleic acid on other chromosomes.

The promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1a (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter.

Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a tissue-specific promoter, metallothionine promoter, a glucocorticoid promoter, a progesterone promoter, and a tetracycline promoter. In some embodiments, expression of a fusogen is upregulated before fusosomes are generated, e.g., 3, 6, 9, 12, 24, 26, 48, 60, or 72 hours before fusosomes are generated.

The expression vector to be introduced into the source can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes may be used for identifying potentially transfected cells and for evaluating the functionality of regulatory sequences. In general, a reporter gene is a gene that is not present in or expressed by the recipient source and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In some embodiments, a cell may be genetically modified to alter expression of one or more proteins. Expression of the one or more proteins may be modified for a specific time, e.g., development or differentiation state of the source. In some embodiments, fusosomes are generated from a source of cells genetically modified to alter expression of one or more proteins, e.g., fusogen proteins or non-fusogen proteins that affect fusion activity, structure or function. Expression of the one or more proteins may be restricted to a specific location(s) or widespread throughout the source.

In some embodiments, the expression of a fusogen protein is modified. In some embodiments, fusosomes are generated from cells with modified expression of a fusogen protein, e.g., an increase or a decrease in expression of a fusogen by at least 10%, 15%, 20%, 30%, 40%, 50%, 60%, 75%, 80%, 90% or more.

In some embodiments, cells may be engineered to express a cytosolic enzyme (e.g., proteases, phosphatases, kinases, demethylases, methyltransferases, acetylases) that targets a fusogen protein. In some embodiments, the cytosolic enzyme affects one or more fusogens by altering post-translational modifications. Post-translational protein modifications of proteins may affect responsiveness to nutrient availability and redox conditions, and protein-protein interactions. In some embodiments, a fusosome comprises fusogens with altered post-translational modifications, e.g., an increase or a decrease in post-translational modifications by at least 10%, 15%, 20%, 30%, 40%, 50%, 60%, 75%, 80%, 90% or more.

Methods of introducing a modification into a cell include physical, biological and chemical methods. See, for example, Geng. & Lu, Microfluidic electroporation for cellular analysis and delivery. Lab on a Chip. 13(19):3803-21. 2013; Sharei, A. et al. A vector-free microfluidic platform for intracellular delivery. PNAS vol. 110 no. 6. 2013; Yin, H. et al., Non-viral vectors for gene-based therapy. Nature Reviews Genetics. 15: 541-555. 2014. Suitable methods for modifying a cell for use in generating the fusosomes described herein include, for example, diffusion, osmosis, osmotic pulsing, osmotic shock, hypotonic lysis, hypotonic dialysis, ionophoresis, electroporation, sonication, microinjection, calcium precipitation, membrane intercalation, lipid mediated transfection, detergent treatment, viral infection, receptor mediated endocytosis, use of protein transduction domains, particle firing, membrane fusion, freeze-thawing, mechanical disruption, and filtration.

Confirming the presence of a genetic modification includes a variety of assays. Such assays include, for example, molecular biological assays, such as Southern and Northern blotting, RT-PCR and PCR; biochemical assays, such as detecting the presence or absence of a particular peptide, e.g., by immunological means (ELISAs and Western blots) or by assays described herein.

Fusosome Modifications

In some aspects, a modification is made to the fusosome. Such modifications can be effective to, e.g., improve targeting, function, or structure.

In some embodiments, the fusosome is treated with a fusogen, e.g., a chemical fusogen described herein, that may non-covalently or covalently link to the surface of the membrane. In some embodiments, the fusosome is treated with a fusogen, e.g., a protein or a lipid fusogen, that may non-covalently or covalently link or embed itself in the membrane.

In some embodiments, a ligand is conjugated to the surface of the fusosome via a functional chemical group (carboxylic acids, aldehydes, amines, sulfhydryls and hydroxyls) that is present on the surface of the fusosome.

Such reactive groups include without limitation maleimide groups. As an example, fusosomes may be synthesized to include maleimide conjugated phospholipids such as without limitation DSPE-MaL-PEG2000.

In some embodiments, a small molecule or lipid, synthetic or native, may be covalently or non-covalent linked to the surface of the fusosome. In some embodiments, a membrane lipid in the fusosome may be modified to promote, induce, or enhance fusogenic properties.

In some embodiments, the fusosome is modified by loading with modified proteins (e.g., enable novel functionality, alter post-translational modifications, bind to the mitochondrial membrane and/or mitochondrial membrane proteins, form a cleavable protein with a heterologous function, form a protein destined for proteolytic degradation, assay the agent's location and levels, or deliver the agent as a carrier). In some embodiments, a fusosome is loaded with one or more modified proteins.

In some embodiments, a protein exogenous relative to the source cell is non-covalently bound to the fusosome. The protein may include a cleavable domain for release. In some embodiments, the invention includes a fusosome comprising an exogenous protein with a cleavable domain.

In some embodiments, the fusosome is modified with a protein destined for proteolytic degradation. A variety of proteases recognize specific protein amino acid sequences and target the proteins for degradation. These protein degrading enzymes can be used to specifically degrade proteins having a proteolytic degradation sequence. In some embodiments, a fusosome comprises modulated levels of one or more protein degrading enzymes, e.g., an increase or a decrease in protein degrading enzymes by at least 10%, 15%, 20%, 30%, 40%, 50%, 60%, 75%, 80%, 90% or more.

As described herein, non-fusogen additives may be added to the fusosome to modify their structure and/or properties. For example, either cholesterol or sphingomyelin may be added to the membrane to help stabilize the structure and to prevent the leakage of the inner cargo. Further, membranes can be prepared from hydrogenated egg phosphatidylcholine or egg phosphatidylcholine, cholesterol, and dicetyl phosphate. (see, e.g., Spuch and Navarro, Journal of Drug Delivery, vol. 2011, Article ID 469679, 12 pages, 2011. doi:10.1155/2011/469679 for review).

In some embodiments, the fusosome comprises one or more targeting groups (e.g., a targeting protein) on the exterior surface to target a specific cell or tissue type (e.g., cardiomyocytes). These targeting groups include without limitation receptors, ligands, antibodies, and the like. These targeting groups bind their partner on the target cells' surface. In embodiments, the targeting protein is specific for a cell surface marker on a target cell described herein, e.g., a skin cell, cardiomyocyte, hepatocyte, intestinal cell (e.g., cell of the small intestine), pancreatic cell, brain cell, prostate cell, lung cell, colon cell, or bone marrow cell.

In some embodiments, the fusosome described herein is functionalized with a diagnostic agent. Examples of diagnostic agents include, but are not limited to, commercially available imaging agents used in positron emissions tomography (PET), computer assisted tomography (CAT), single photon emission computerized tomography, x-ray, fluoroscopy, and magnetic resonance imaging (MRI); and contrast agents. Examples of suitable materials for use as contrast agents in MRI include gadolinium chelates, as well as iron, magnesium, manganese, copper, and chromium.

Another example of introducing functional groups to the fusosome is during post-preparation, by direct crosslinking fusosome and ligands with homo- or heterobifunctional crosslinkers. This procedure may use a suitable chemistry and a class of crosslinkers (CDI, EDAC, glutaraldehydes, etc. as discussed herein) or any other crosslinker that couples a ligand to the fusosome surface via chemical modification of the fusosome surface after preparation. This also includes a process whereby amphiphilic molecules such as fatty acids, lipids or functional stabilizers may be passively adsorbed and adhered to the fusosome surface, thereby introducing functional end groups for tethering to ligands.

Cargo

In some embodiments, a fusosome described herein includes a cargo that is or comprises a membrane protein payload agent. In some embodiments, the membrane protein payload agent may be or may encode a therapeutic protein. A fusosome may additionally include other cargo, e.g., in some embodiments, a fusosome described herein includes a cargo that is or comprises a therapeutic agent. In some embodiments, a fusosome described herein includes a plurality of membrane payload agents. In some embodiments, a fusosome described herein includes a cargo that is or comprises a plurality of therapeutic agents. In some embodiments, a fusosome comprises a cargo comprising one or more membrane protein payload agents and one or more therapeutic agents. In some embodiments, a cargo may be a therapeutic agent that is exogenous or endogenous relative to the source cell.

In some embodiments a fusosome comprises a cargo associated with the fusosome lipid bilayer. In some embodiments a fusosome comprises a cargo disposed within the lumen of the fusosome. In some embodiments, a fusosome comprises a cargo associated with the fusosome lipid bilayer and a cargo disposed within the lumen of the fusosome.

In some embodiments, a cargo is not expressed naturally in a cell from which the fusosome is derived. In some embodiments, a cargo is expressed naturally in the cell from which a fusosome is derived. In some embodiments, a cargo is a mutant of a wild type nucleic acid or protein expressed naturally in a cell from which the fusosome is derived or is a wild type of a mutant expressed naturally in a cell from which a fusosome is derived.

In some embodiments, a cargo is loaded into a fusosome via expression in a cell from which the fusosome is derived (e.g. expression from DNA introduced via transfection, transduction, or electroporation). In some embodiments, a cargo is expressed from DNA integrated into the genome of the cell from which the fusosome is derived or maintained episosomally in the cell from which the fusosome is derived. In some embodiments, expression of a cargo is constitutive in the cell from which the fusosome is derived. In some embodiments, expression of a cargo in the cell from which the fusosome is derived is induced. In some embodiments, expression of the cargo is induced in the cell from which the fusosome is derived immediately prior to generating the fusosome. In some embodiments, expression of a cargo in the cell from which the fusosome is derived is induced at the same time as expression of the fusogen in the cell from which the fusosome is derived.

In some embodiments, a cargo is loaded into a fusosome via electroporation into the fusosome itself or into a cell from which the fusosome is derived. In some embodiments, a cargo is loaded into a fusosome via transfection into the fusosome itself or into a cell from which the fusosome is derived.

In some aspects, the disclosure provides a fusosome composition (e.g., a pharmaceutical composition) comprising: (i) one or more of a chondrisome (e.g., as described in international application, PCT/US16/64251), a mitochondrion, an organelle (e.g., Mitochondria, Lysosomes, nucleus, cell membrane, cytoplasm, endoplasmic reticulum, ribosomes, vacuoles, endosomes, spliceosomes, polymerases, capsids, acrosome, autophagosome, centriole, glycosome, glyoxysome, hydrogenosome, melanosome, mitosome, myofibril, cnidocyst, peroxisome, proteasome, vesicle, stress granule, and networks of organelles), or an enucleated cell, e.g., an enucleated cell comprising any of the foregoing, and (ii) a fusogen, e.g., a myomaker protein.

In embodiments, the fusogen is present in a lipid bilayer external to the mitochondrion or chondrisome. In embodiments, the chondrisome has one or more of the properties as described, for example, in international application, PCT/US16/64251, which is herein incorporated by reference in its entirety, including the Examples and the Summary of the Invention.

In some embodiments, the cargo may include one or more nucleic acid sequences, one or more polypeptides, a combination of nucleic acid sequences and/or polypeptides, one or more organelles, and any combination thereof. In some embodiments, the cargo may include one or more cellular components. In some embodiments, the cargo includes one or more cytosolic and/or nuclear components.

In some embodiments, the cargo includes a nucleic acid, e.g., DNA, nDNA (nuclear DNA), mtDNA (mitochondrial DNA), protein coding DNA, gene, operon, chromosome, genome, transposon, retrotransposon, viral genome, intron, exon, modified DNA, mRNA (messenger RNA), tRNA (transfer RNA), modified RNA, microRNA, siRNA (small interfering RNA), tmRNA (transfer messenger RNA), rRNA (ribosomal RNA), mtRNA (mitochondrial RNA), snRNA (small nuclear RNA), small nucleolar RNA (snoRNA), SmY RNA (mRNA trans-splicing RNA), gRNA (guide RNA), TERC (telomerase RNA component), aRNA (antisense RNA), cis-NAT (Cis-natural antisense transcript), CRISPR RNA (crRNA), lncRNA (long noncoding RNA), piRNA (piwi-interacting RNA), shRNA (short hairpin RNA), tasiRNA (trans-acting siRNA), eRNA (enhancer RNA), satellite RNA, pcRNA (protein coding RNA), dsRNA (double stranded RNA), RNAi (interfering RNA), circRNA (circular RNA), reprogramming RNAs, aptamers, and any combination thereof. In some embodiments, the nucleic acid is a wild-type nucleic acid. In some embodiments, the protein is a mutant nucleic acid. In some embodiments the nucleic acid is a fusion or chimera of multiple nucleic acid sequences.

In some embodiments, DNA in the fusosome or DNA in the cell that the fusosome is derived from is edited to correct a genetic mutation using a gene editing technology, e.g. a guide RNA and CRISPR-Cas9/Cpf1, or using a different targeted endonuclease (e.g., Zinc-finger nucleases, transcription-activator-like nucleases (TALENs)). In some embodiments, the genetic mutation is linked to a disease in a subject. Examples of edits to DNA include small insertions/deletions, large deletions, gene corrections with template DNA, or large insertions of DNA. In some embodiments, gene editing is accomplished with non-homologous end joining (NHEJ) or homology directed repair (HDR). In some embodiments, the edit is a knockout. In some embodiments, the edit is a knock-in. In some embodiments, both alleles of DNA are edited. In some embodiments, a single allele is edited. In some embodiments, multiple edits are made. In some embodiments, the fusosome or cell is derived from a subject, or is genetically matched to the subject, or is immunologically compatible with the subject (e.g. having similar MHC).

In some embodiments, the cargo may include a nucleic acid. For example, the cargo may comprise RNA to enhance expression of an endogenous protein (e.g., in some embodiments, endogenous relative to the source cell, and in some embodiments, endogenous relative to the target cell), or a siRNA or miRNA that inhibits protein expression of an endogenous protein. For example, the endogenous protein may modulate structure or function in the target cells. In some embodiments, the cargo may include a nucleic acid encoding an engineered protein that modulates structure or function in the target cells. In some embodiments, the cargo is a nucleic acid that targets a transcriptional activator that modulate structure or function in the target cells.

In some embodiments, the cargo comprises a self-replicating RNA, e.g., as described herein. In some embodiments, the self-replicating RNA is single stranded RNA and/or linear RNA. In some embodiments, the self-replicating RNA encodes one or more proteins, e.g., a protein described herein, e.g., a membrane protein, a secreted protein, a nuclear protein, or an organellar protein. In some embodiments, the self-replicating RNA comprises a partial or complete genome from arterivirus or alphavirus, or a variant thereof.

In some embodiments, the cargo can comprise an RNA that can be delivered into a target cell, and RNA is replicated inside the target cell. Replication of the self-replicating RNA can involve RNA replication machinery that is exogenous to the host cell, and/or RNA replication machinery that is endogenous to the host cell.

In some embodiments, the self-replicating RNA comprises a viral genome, or a self-replicating portion or analog thereof. In some embodiments, the self-replicating RNA is from a positive-sense single-stranded RNA virus. In some embodiments, the self-replicating RNA comprises a partial or complete arterivirus genome, or a variant thereof. In some embodiments, the arterivirus comprises Equine arteritis virus (EAV), Porcine respiratory and reproductive syndrome virus (PRRSV), Lactate dehydrogenase elevating virus (LDV), and Simian hemorrhagic fever virus (SHFV). In some embodiments, the self-replicating RNA comprises a partial or complete alphavirus genome, or a variant thereof. In some embodiments, the alphavirus belongs to the VEEV/EEEV group (e.g., Venezuelan equine encephalitis virus), the SF group, or the SIN group.

In some embodiments, the fusosome that comprises the self-replicating RNA further comprises: (i) one or more proteins that promote replication of the RNA, or (ii) a nucleic acid encoding one or more proteins that promote replication of the RNA, e.g., as part of the self-replicating RNA or in a separate nucleic acid molecule.

In some embodiments, the self-replicating RNA lacks at least one functional gene encoding one or more viral structural protein relative to the corresponding wild-type genome. For instance, in some embodiments the self-replicating RNA fully lacks one or more genes for viral structural proteins or comprises a non-functional mutant gene for a viral structural protein. In some embodiments, the self-replicating RNA does not comprise any genes for viral structural proteins.

In some embodiments, the self-replicating RNA comprises a viral capsid enhancer, e.g., as described in International Application WO2018/106615, which is hereby incorporated by reference in its entirety. In some embodiments, the viral capsid enhancer is an RNA structure that increases translation of a coding sequence in cis, e.g., by allowing eIF2alpha independent translation of the coding sequence. In some embodiments, a host cell has impaired translation, e.g., due to PKR-mediated phosphorylation of eIF2alpha. In embodiments, the viral capsid enhancer comprises a Downstream Loop (DLP) from a viral capsid protein, or a variant of the DLP. In some embodiments, the viral capsid enhancer is from a virus belonging to the Togaviridae family, e.g., the Alphavirus genus of the Togaviridae family. In some embodiments, the viral capsid enhancer has a sequence of SEQ ID NO: 1 of WO2018/106615 (which sequence is herein incorporated by reference in its entirety), or a sequence having at least 70%, 80%, 85%, 90%, 95%, or 99% identity thereto. In some embodiments, the sequence has the same secondary structure shown in FIG. 1 of WO2018/106615.

In some embodiments, the self-replicating RNA comprises one or more arterivirus sequences, e.g., as described in International Application WO2017/180770, which is hereby incorporated by reference in its entirety. In some embodiments, the self-replicating RNA comprises ORF7 (or a functional fragment or variant thereof) and/or the self-replicating RNA lacks a functional ORF2a (e.g., fully lacks ORF2a, or comprises a non-functional mutant of ORF2a) of an arterivirus. In some embodiments, the self-replicating RNA lacks a functional ORF2b, ORF3, ORF4, ORF5a, ORF5, or ORF6 or any combination thereof (e.g., fully lacks the sequence(s) or comprises a non-functional mutant of the sequence(s)). In some embodiments, the self-replicating RNA lacks a portion of one or more of ORF2a, ORF2b, ORF3, ORF4, ORF5a, ORF5, or ORF6. In some embodiments, the self-replicating RNA comprises one or more subgenomic (sg) promoters, e.g., situated at a non-native site. In some embodiments, the promoter comprises sg promoter 1, sg promoter 2, sg promoter 3, sg promoter 4, sg promoter 5, sg promoter 6, sg promoter 7, or a functional fragment or variant thereof. In some embodiments, the self-replicating RNA comprises one or more transcriptional termination signals, e.g., T7 transcriptional termination signals, e.g., a mutant T7 transcription termination signal, e.g., a mutant T7 transcription termination signal comprising one or more of (e.g., any two of, or all of) T9001G, T3185A, or G3188A.

In some embodiments, the self-replicating RNA comprises a 5' UTR, e.g., a mutant alphavirus 5' UTR, e.g., as described in International Application WO2018/075235, which is hereby incorporated by reference in its entirety. In some embodiments, the mutant alphavirus 5' UTR comprises one or more nucleotide substitutions at position 1, 2, 4, or a combination thereof. In some embodiments, the mutant alphavirus 5' UTR comprises a U→G substitution at position 2.

In some embodiments, the cargo includes a polypeptide, e.g., enzymes, structural polypeptides, signaling polypeptides, regulatory polypeptides, transport polypeptides, sensory polypeptides, motor polypeptides, defense polypeptides, storage polypeptides, transcription factors, antibodies, cytokines, hormones, catabolic polypeptides, anabolic polypeptides, proteolytic polypeptides, metabolic polypeptides, kinases, transferases, hydrolases, lyases, isomerases, ligases, enzyme modulator polypeptides, protein binding polypeptides, lipid binding polypeptides, membrane fusion polypeptides, cell differentiation polypeptides, epigenetic polypeptides, cell death polypeptides, nuclear transport polypeptides, nucleic acid binding polypeptides, reprogramming polypeptides, DNA editing polypeptides, DNA repair polypeptides, DNA recombination polypeptides, DNA integration polypeptides, targeted endonucleases (e.g. Zinc-finger nucleases, transcription-activator-like nucleases (TALENs), cas9 and homologs thereof), recombinases, and any combination thereof. In some embodiments the protein targets a protein in the cell for degradation. In some embodiments the protein targets a protein in the cell for degradation by localizing the protein to the proteasome. In some embodiments, the protein is a wild-type protein. In some embodiments, the protein is a mutant protein. In some embodiments the protein is a fusion or chimeric protein.

In some embodiments, the cargo includes a small molecule, e.g., ions (e.g. $Ca^{2+}$, $Cl^-$, $Fe^{2+}$), carbohydrates, lipids, reactive oxygen species, reactive nitrogen species, isoprenoids, signaling molecules, heme, polypeptide cofactors, electron accepting compounds, electron donating compounds, metabolites, ligands, and any combination thereof. In some embodiments the small molecule is a pharmaceutical that interacts with a target in the cell. In some embodiments the small molecule targets a protein in the cell for degradation. In some embodiments the small molecule targets a protein in the cell for degradation by localizing the protein to the proteasome. In some embodiments that small molecule is a proteolysis targeting chimera molecule (PROTAC).

In some embodiments, the cargo includes a mixture of proteins, nucleic acids, or metabolites, e.g., multiple polypeptides, multiple nucleic acids, multiple small molecules; combinations of nucleic acids, polypeptides, and small molecules; ribonucleoprotein complexes (e.g. Cas9-gRNA complex); multiple transcription factors, multiple epigenetic factors, reprogramming factors (e.g. Oct4, Sox2, cMyc, and Klf4); multiple regulatory RNAs; and any combination thereof.

In some embodiments, the cargo includes one or more organelles, e.g., chondrisomes, mitochondria, lysosomes, nucleus, cell membrane, cytoplasm, endoplasmic reticulum, ribosomes, vacuoles, endosomes, spliceosomes, polymerases, capsids, acrosome, autophagosome, centriole, glycosome, glyoxysome, hydrogenosome, melanosome, mitosome, myofibril, cnidocyst, peroxisome, proteasome, vesicle, stress granule, networks of organelles, and any combination thereof.

In some embodiments, the cargo is enriched at the fusosome or cell membrane. In some embodiments, the cargo is enriched by targeting to the membrane via a peptide signal sequence. In some embodiments, the cargo is enriched by binding with a membrane associated protein, lipid, or small molecule. In some embodiments, the cargo is enriched by dimerizing with a membrane associated protein, lipid, or small molecule. In some embodiments the cargo is chimeric (e.g. a chimeric protein, or nucleic acid) and comprises a domain that mediates binding or dimerization with a membrane associated protein, lipid, or small molecule. Membrane-associated proteins of interest include, but are not limited to, any protein having a domain that stably associates, e.g., binds to, integrates into, etc., a cell membrane (i.e., a membrane-association domain), where such domains may include myristoylated domains, farnesylated domains, transmembrane domains, and the like. Specific membrane-associated proteins of interest include, but are not limited to: myristoylated proteins, e.g., p 60 v-src and the like; farnesylated proteins, e.g., Ras, Rheb and CENP-E,F, proteins binding specific lipid bilayer components e.g. AnnexinV, by binding to phosphatidyl-serine, a lipid component of the cell membrane bilayer and the like; membrane anchor proteins; transmembrane proteins, e.g., transferrin receptors and portions thereof; and membrane fusion proteins. In some embodiments, the membrane associated protein contains a first dimerization domain. The first dimerization domain may be, e.g., a domain that directly binds to a second dimerization domain of a cargo or binds to a second dimerization domain via a dimerization mediator. In some embodiments the cargo contains a second dimerization domain. The second dimerization domain may be, e.g., a domain that dimerizes (e.g., stably associates with, such as by non-covalent bonding interaction, either directly or through a mediator) with the first dimerization domain of the membrane associated protein either directly or through a dimerization mediator. With respect to the dimerization domains, these domains are domains that participate in a binding event, either directly or via a dimerization mediator, where the binding event results in production of the desired multimeric, e.g., dimeric, complex of the membrane associated and target proteins. The first and second dimerization domains may be homodimeric, such that they are made up of the same sequence of amino acids, or heterodimeric, such that they are made up of differing sequences of amino acids. Dimerization domains may vary, where domains of interest include, but are not limited to: ligands of target biomolecules, such as ligands that specifically bind to particular proteins of interest (e.g., protein:protein interaction domains), such as SH2 domains, Paz domains, RING domains, transcriptional activator domains, DNA binding domains, enzyme catalytic domains, enzyme regulatory domains, enzyme subunits, domains for localization to a defined cellular location, recognition domains for the localization domain, the domains listed at URL: pawsonlab.mshri.on.ca/index.php?option=com_content&task=view&id=30&Itemid=63/ etc. In some embodiments the first dimerization domain binds nucleic acid (e.g. mRNA, miRNA, siRNA, DNA) and the second dimerization domain is a nucleic acid sequence present on the cargo (e.g. the first dimerization domain is MS2 and the second dimerization domain is the high affinity binding loop of MS2 RNA). Any convenient compound that functions as a dimerization mediator may be employed. A wide variety of compounds, including both naturally occurring and synthetic substances, can be used as dimerization mediators. Applicable and readily observable or measurable criteria for selecting a dimerization mediator include: (A) the ligand is physiologically acceptable (i.e., lacks undue toxicity towards the cell or animal for which it is to be used); (B) it has a reasonable therapeutic dosage range; (C) it can cross the cellular and other membranes, as necessary (where in some instances it may be able to mediate dimerization from outside of the cell), and (D) binds to the target domains of the chimeric proteins for which it is designed with reasonable affinity for the desired application. A first desirable criterion is that the compound is relatively physiologically inert, but for its dimerization mediator activity. In some instances, the ligands will be non-peptide and non-nucleic acid. Additional dimerization domains are described, e.g., in US20170087087 and US20170130197, each of which is herein incorporated by reference in its entirety.

Payload Agents

The methods and compositions described herein can be used to target payloads (e.g., payload agents). For instance, payload agents can be targeted to a cellular membrane, e.g., through the use of a co-translational endoplasmic reticulum (ER) signal. The cellular membrane can be, e.g., an ER membrane, a plasma membrane, membrane of secreted and/or secretory vesicles, or lysosomal membrane. In some embodiments, payload agents are targeted for secretion. In some embodiments, the methods and compositions described herein can be used to target payloads to the lumen of an organelle (e.g. a Golgi apparatus, secretory vesicle, or lysosome) after translation in the ER. In some embodiments, payload agents can be targeted to the nucleus, e.g., through the use of a nuclear localization signal. In another example, payload agents can be targeted to the mitochondria or peroxisome, e.g., through the use of a mitochondria or peroxisome localization signal, respectively.

A protein payload agent (e.g., a membrane protein payload agent or a secreted protein payload agent) may be or comprise, e.g., a protein, or a nucleic acid encoding a protein, selected from: a perinuclear membrane protein, an inner nuclear membrane protein, a nucleoplasm protein, a nucleolus protein, a perionucleolar protein, a cajal body protein, a clastosome protein, a gems nuclear bodies protein, a histone body protein, a nuclear speckles protein, a nuclear stress body protein, a paraspeckle protein, a PML bodies protein, a polycomb body protein, a transmembrane protein, a cell surface protein, a protein associated with the cytosolic side of a membrane, an endoplasmic reticulum protein, a lysosome protein, a Golgi apparatus protein, a secreted protein, a secretory vesicle protein, a mitochondrial membrane protein, an outer mitochondrial membrane protein, an inner mitochondrial membrane protein, a mitochondrial inner boundary membrane protein, a mitochondrial cristal membrane protein, a mitochondrial DNA protein, a mitochondrial intermembrane space protein, a mitochondrial matrix protein, a mitochondrial matrix granule protein, a mitochondrial cristae protein, a mitochondrial ribosome protein, a mitochondrial intracristal protein, a mitochondrial peripheral space protein, a peroxisomal membrane protein, a peroxisomal crystalloid core protein, a peroxisomal matrix protein, a peroxin, or an endosomal protein, or a combination thereof.

In some embodiments, the membrane protein payload agent is an exogenous version of a protein that is naturally present in or targeted to the target membrane. In some embodiments, the membrane protein payload agent is not naturally present or targeted to the target membrane. In some embodiments, a protein payload agent (e.g., a membrane protein payload agent or a secreted protein payload agent) may be or comprise, e.g., a protein, or a nucleic acid encoding a protein, selected from: a cell surface receptor protein, a transporter, an ion channel, membrane associated enzyme, a cell adhesion protein, an immunoglobulin, a T cell receptor, an endoplasmic reticulum protein, a lysosome protein, a Golgi apparatus protein, a secreted protein, a secretory vesicle protein, an endosomal protein. A membrane protein payload agent may be, e.g., a recombinant version of a naturally occurring membrane protein, or a synthetic protein, e.g., a protein having a sequence not found in nature or domains not found together in nature, e.g., a chimeric membrane protein, e.g., a transmembrane protein having an extracellular domain derived from a first naturally occurring protein and a transmembrane domain and/or intracellular domain derived from a second naturally occurring protein, e.g., a chimeric antigen receptor.

In some embodiments, the nuclear protein payload agent is an exogenous version of a protein that is naturally present in or targeted to the nucleus. In some embodiments, the nuclear protein payload agent is not naturally present or targeted to the nucleus. In some embodiments, a protein payload agent (e.g., a nuclear protein payload agent) may be or comprise, e.g., a protein, or a nucleic acid encoding a protein, selected from: a transcription factor, a nuclease, a recombinase, an epigenetic factor, a post-transcriptional RNA modification factor (e.g. an mRNA splicing factor), a non-coding RNA (e.g. a snRNA or snoRNA) or ribonucleic protein (e.g. a snRNP or snoRNP), a structural protein (e.g. a lamin or karysokeletal protein). A nuclear protein payload agent may be, e.g., a recombinant version of a naturally occurring nuclear protein, or a synthetic protein, e.g., a protein having a sequence not found in nature or domains not found together in nature, e.g., a chimeric nuclear protein, e.g., a nuclear protein composed of a translational fusion or association between a DNA binding domain derived from a zinc-finger, a TAL, or an RNA-guided protein, or other DNA binding domains known in the art, and a nucleic acid modifying domain from a second protein, e.g., a nuclease, a recombinase, a base editor (e.g. a deaminase), a nickase, a transcription factor (e.g. an activator or a repressor), a viral motif that alters DNA regulation (e.g. VP16 or VP64), an epigenetic modifying factor (e.g. a demethylase), or nucleic acid modifying domain known in the art.

An organellar protein payload agent may be, e.g., a recombinant version of a naturally occurring nuclear protein, or a synthetic protein, e.g., a protein having a sequence not found in nature or domains not found together in nature, e.g., a chimeric mitochondria or peroxisome protein, e.g., a mitochondria or peroxisome protein composed of a translational fusion or association between a mtDNA binding domain derived from a zinc-finger, a TAL, or an RNA-guided protein, or other mtDNA binding domains known in the art, and a nucleic acid modifying domain from a second protein, e.g., a nuclease, a recombinase, a base editor (e.g. a deaminase), a nickase, a transcription factor (e.g. an activator or a repressor), or nucleic acid modifying domain known in the art.

In some embodiments, the mitochondria or perixosome protein payload agent is an exogenous version of a protein that is naturally present in or targeted to the mitochondria or peroxisome. In some embodiments, the mitochondria or peroxisome protein payload agent is not naturally present or targeted to the mitochondria or peroxisome. In some embodiments, a protein payload agent (e.g., a mitochondria or peroxisome protein payload agent) may be or comprise, e.g., a protein, or a nucleic acid encoding a protein, selected from: a mitochondrial membrane protein, a outer mitochondrial membrane protein, an inner mitochondrial membrane protein, a mitochondrial inner boundary membrane protein, a mitochondrial cristal membrane protein, a mitochondrial DNA protein, a mitochondrial intermembrane space protein, a mitochondrial matrix protein, a mitochondrial matrix granule protein, a mitochondrial cristae protein, a mitochondrial ribosome protein, a mitochondrial intracristal protein, a mitochondrial peripheral space protein, a peroxisomal membrane protein, a peroxisomal crystalloid core protein, a peroxisomal matrix protein, a peroxin, a transcription factor, a nuclease, a recombinase, an epigenetic factor, a non-coding RNA or ribonucleic protein, a structural protein, an enzyme, a transporter, a respiration complex, a fusion or fission protein, a cytochrome, a signaling protein, an apoptosis protein or factor, a mitochondrial import protein, a mitochondrial export protein, or an electron transport protein.

In some embodiments, the payload agent (e.g., membrane protein payload agent, nuclear protein payload agent, mitochondria protein payload agent, or perixosome protein payload agent) comprises a protein (e.g., a synthetic protein) comprising an effector domain linked to a localization domain (e.g., TAL, ZF, Cas9, or meganuclease). Exemplary effector domains include, without limitation, nucleases, recombinases, integrases, base editors (e.g., deaminases), transcription factors, and epigenetic modifiers.

In some embodiments, a fusosome comprises a protein payload agent (e.g., a membrane protein payload agent, nuclear protein payload agent, organellar protein payload agent, mitochondria protein payload agent, or peroxisome protein payload agent, e.g., as described herein, or a secreted protein payload agent). In some embodiments, a protein payload agent is a protein and/or a nucleic acid that encodes it. In some embodiments the protein is expressed in a cell line and then incorporated into a fusosome. A person of ordinary skill will appreciate that to the extent any such protein is expressed by the cell line, the cell line is capable of any post-translational processing necessary to make the protein. In some embodiments post-translational processing comprises one or more of protein splicing, protein cleavage, protein folding, protein glycosylation, dimerization, etc.

In some embodiments, the protein (e.g., membrane protein, nuclear protein, organellar protein payload agent, mitochondria protein payload agent, or peroxisome protein payload agent, e.g., as described herein, or secreted protein) is expressed by the source cell from which a fusosome is derived. A person of ordinary skill will appreciate that to the extent any such protein is expressed by the source cell, the source cell is capable of any post-translational processing necessary to make the protein. In some embodiments post-translational processing comprises one or more of protein splicing, protein cleavage, protein folding, protein glycosylation, dimerization, etc. In some embodiments a protein payload agent is a nucleic acid. In some embodiments the nucleic acid encodes a cell surface or nuclear protein. In some embodiments the nucleic acid encodes an outer nuclear membrane protein, a perinuclear membrane protein, an inner nuclear membrane protein, a nucleoplasm protein, a nucleolus protein, an endoplasmic reticulum protein, a lysosome protein, a Golgi apparatus protein, a secreted protein, a secretory vesicle protein, organellar protein, mitochondria protein, or peroxisome protein, or an endosomal protein. In some embodiments a protein payload agent, e.g., membrane protein payload agent, nuclear protein payload agent, or organellar protein payload agent, e.g., as described herein, is a protein or nucleic acid encoding a protein selected from the cell surface antigens described herein. In some embodiments the nucleic acid encodes an engineered cell surface protein. In some embodiments an engineered cell surface protein is a chimeric antigen receptor. In some embodiments, the nucleic acid encodes a mitochondrial membrane protein, a outer mitochondrial membrane protein, an inner mitochondrial membrane protein, a mitochondrial inner boundary membrane protein, a mitochondrial cristal membrane protein, a mitochondrial DNA protein, a mitochondrial intermembrane space protein, a mitochondrial matrix protein, a mitochondrial matrix granule protein, a mitochondrial cristae protein, a mitochondrial ribosome protein, a mitochondrial intracristal protein, a mitochondrial peripheral space protein, a peroxisomal membrane protein, a peroxisomal crystalloid core protein, a peroxisomal matrix protein, or a peroxinin. In some embodiments a protein payload agent, e.g., mitochondria or peroxisome protein payload agent, is a protein or nucleic acid encoding a protein selected from the mitochondria or peroxisome proteins described herein.

In some embodiments, a protein payload agent (e.g., a membrane protein payload agent, nuclear protein payload agent, organellar protein payload agent, mitochondria protein payload agent, or peroxisome protein payload agent, or a secreted protein payload agent, e.g., as described herein) comprises a nucleic acid which is expressed by the fused target cell. A person of ordinary skill will appreciate that to the extent any protein produced by expression of a nucleic acid protein payload agent (e.g., membrane protein payload agent, nuclear protein payload agent, organellar protein payload agent, mitochondria protein payload agent, or peroxisome protein payload agent, e.g., as described herein) requires post-translational processing, such post-translational processing will be performed in the fused target cell. In some embodiments post-translational may comprise one or more of protein splicing, protein cleavage, protein folding, protein glycosylation, dimerization, etc. In some embodiments, the post-translational modification is a covalent attachment of a lipid, such as a fatty acid, isoprenoid, sterol, phospholipid, glycosylphosphatidyl inositol (GPI), cholesterol, farnesyl, geranylgeranyl, myristoyl, palmitoyl, which in some embodiments targets the protein to the plasma membrane. In some embodiments, the post-translational modification is direct phosphorylation of a nuclear localization sequence.

In some embodiments, the protein payload agent (e.g., a membrane protein payload agent, nuclear protein payload agent, organellar protein payload agent, mitochondria protein payload agent, or peroxisome protein payload agent, or a secreted protein payload agent, e.g., as described herein) comprises a nucleic acid, e.g., RNA or DNA. In some embodiments, the nucleic acid is, comprises, or consists of one or more natural nucleic acid residues. In some embodiments, the nucleic acid is, comprises, or consists of one or more nucleic acid analogs. In some embodiments, the nucleic acid has a nucleotide sequence that encodes a functional gene product such as an RNA or protein. In some embodiments, the nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, the nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, the nucleic acid is partly or wholly single stranded; in some embodiments, the nucleic acid is partly or wholly double stranded. In some embodiments the nucleic acid has a nucleotide sequence comprising at least one element that encodes, or is the complement of a sequence that encodes, a polypeptide. The nucleic acid may include variants, e.g., having an overall sequence identity with a reference nucleic acid of at least 85%, 86%, 87%, 88%, 89%, 90%, 91%, 92%, 93%, 94%, 95%, 96%, 97%, or 99%. In some embodiments, a variant nucleic acid does not share at least one characteristic sequence element with a reference nucleic acid. In some embodiments, a variant nucleic acid shares one or more of the biological activities of the reference nucleic acid. In some embodiments, a nucleic acid variant has a nucleic acid sequence that is identical to that of the reference but for a small number of sequence alterations at particular positions. In some embodiments, fewer than about 20%, about 15%, about 10%, about 9%, about 8%, about 7%, about 6%, about 5%, about 4%, about 3%, or about 2% of the residues in a variant are substituted, inserted, or deleted, as compared to the reference. In some embodiments, a variant nucleic acid comprises about 10, about 9, about 8, about 7, about 6, about 5, about 4, about 3, about 2, or about 1 substituted residues as compared to a reference. In some embodiments, a variant nucleic acid comprises a very small number (e.g., fewer than about 5, about 4, about 3, about 2, or about 1) number of substituted, inserted, or deleted, functional residues that participate in a particular biological activity relative to the reference. In some embodiments, a variant nucleic acid comprises not more than about 15, about 12, about 9, about 3, or about 1 addition or deletion, and, in some embodiments, comprises no additions or deletions, as compared to the reference. In some embodiments, a variant nucleic acid comprises fewer than about 27, about 24, about 21, about 18, about 15, about 12, about 9, about 6, about 3, or fewer than about 9, about 6, about 3, or about 2 additions or deletions as compared to the reference.

In some embodiments, the protein payload agent (e.g., a membrane protein payload agent, nuclear protein payload agent, organellar protein payload agent, mitochondria, protein payload agent, or peroxisome protein payload agent, or a secreted protein payload agent e.g., as described herein) comprises a protein. The protein may include moieties other than amino acids (e.g., may be glycoproteins, proteoglycans, etc.) and/or may be otherwise processed or modified. The protein can sometimes include more than one polypeptide chain, for example linked by one or more disulfide bonds or associated by other means. The protein may contain L-amino acids, D-amino acids, or both and may contain any of a variety of amino acid modifications or analogs. In some embodiments, proteins may comprise natural amino acids, non-natural amino acids, synthetic amino acids, and combinations thereof. In some embodiments, proteins are antibodies, antibody fragments, biologically active portions thereof, and/or characteristic portions thereof. A polypeptide may include its variants, e.g., having an overall sequence identity with a reference polypeptide of at least 85%, 86%, 87%, 88%, 89%, 90%, 91%, 92%, 93%, 94%, 95%, 96%, 97%, or 99%. In some embodiments, a variant polypeptide does not share at least one characteristic sequence element with a reference polypeptide. In some embodiments, a variant polypeptide shares one or more of the biological activities of the reference polypeptide. In some embodiments, a polypeptide variant has an amino acid sequence that is identical to that of the reference but for a small number of sequence alterations at particular positions. In some embodiments, fewer than about 20%, about 15%, about 10%, about 9%, about 8%, about 7%, about 6%, about 5%, about 4%, about 3%, or about 2% of the residues in a variant are substituted, inserted, or deleted, as compared to the reference. In some embodiments, a variant polypeptide comprises about 10, about 9, about 8, about 7, about 6, about 5, about 4, about 3, about 2, or about 1 substituted residues as compared to a reference. In some embodiments, a variant polypeptide comprises a very small number (e.g., fewer than about 5, about 4, about 3, about 2, or about 1) number of substituted, inserted, or deleted, functional that participate in a particular biological activity relative to the reference. In some embodiments, a variant polypeptide comprises not more than about 5, about 4, about 3, about 2, or about 1 addition or deletion, and, in some embodiments, comprises no additions or deletions, as compared to the reference. In some embodiments, a variant polypeptide comprises fewer than about 25, about 20, about 19, about 18, about 17, about 16, about 15, about 14, about 13, about 10, about 9, about 8, about 7, about 6, and commonly fewer than about 5, about 4, about 3, or about 2 additions or deletions as compared to the reference.

Signal Sequences

In some embodiments, a protein payload agent (e.g., a membrane protein payload agent, nuclear protein payload agent, organellar protein payload agent, mitochondria protein payload agent, or peroxisome protein payload agent, or a secreted protein payload agent, e.g., as described herein) is a protein (or nucleic acid encoding it) that includes or included a signal sequence directing the protein to a particular site or location (e.g., to the cell surface, nucleus, an organelle, mitochondria, or peroxisome). Those skilled in the art will appreciate that, in certain instances, a cell uses "sorting signals" which are amino acid motifs that are at least temporarily part of a protein (e.g., when initially produced), to target the protein to particular subcellular location (e.g., to a particular organelle or surface membrane of a target cell). In some embodiments a sorting signal is a signal sequence, a signal peptide, or a leader sequence, which directs a protein to an organelle called the endoplasmic reticulum (ER), mitochondria, or peroxisome; in some such embodiments, the protein is then delivered to the plasma membrane. See US20160289674A1. In some such embodiments, the protein is then secreted. In some such embodiments, the protein is then trafficked to the lysosome. In some such embodiments, the protein is then trafficked to the Golgi apparatus. In some such embodiments, the protein is then trafficked to a secretory vesicle, and may then be secreted from the cell. In some such embodiments, the protein is then trafficked to an endosome. In some embodiments a sorting signal is a signal sequence, a signal peptide, or a leader sequence, which directs a protein the nucleus (e.g., a nuclear localization sequence); in some such embodiments, the protein is then delivered to the nucleus.

In some embodiments, protein targeting to the ER is cotranslational. In some embodiments protein translocation and membrane insertion are coupled to protein synthesis. In some embodiments a signal sequence may be hydrophobic. In some embodiments a signal sequence may be partially hydrophobic. In some embodiments a signal sequence is recognized by a signal recognition particle (SRP). In some embodiments the SRP recognizing a signal sequence as it emerges from a ribosome. In some embodiments, a nascent peptide chain-ribosome complex is targeted to the ER by binding to an SRP receptor. In some embodiments a signal sequence interacts with an Sec61α subunit of a translocon and initiates translocation of a membrane protein or partial chain of said membrane protein.

In some embodiments, protein targeting to the mitochondria is through a mitochondria localization sequence (also known as a mitochondria signal sequence or presequence) that enables translocation into the mitochondria. Canonical mitochondrial import pathways often require the presence of Tom40 protein, which constitutes a channel of the translocase of the outer membrane (TOM) complex. Apart from the channel itself, the TOM complex contains a number of receptor proteins, such as Tom20, Tom22, and Tom70, that participate in recognition of the incoming precursor proteins. Import through the TOM complex depends on interactions between precursor proteins with receptor domains that are exposed by subunits of the TOM complex. Certain classes of precursor proteins differentially interact with the TOM complex. Precursor proteins that are targeted to mitochondria by the cleavable mitochondrial targeting signal, called a presequence, are first recognized by Tom20 before they interact with Tom22. Hydrophobic precursors of carrier proteins that contain an integral targeting signal require the presence of the Tom70 receptor. On their way through the channel of Tom40, both types of protein precursors interact with the pore, but the pattern of interacting residues of Tom40 is different for the presequence and carrier precursors. In some embodiments the mitochondrial protein is transported post-translationally or co-translationally. Mitochondrial targeting elements can exist as either individual or multiple units scattered along the length of the precursor and vary markedly in terms of sequence, structure and location, reflecting their role in alternative mitochondrial sorting routes. The "classical" mitochondrial targeting signal is a cleavable N-terminal positively charged sequence, termed a presequence, which directs proteins to the mitochondrial matrix, inner membrane and in a few cases the mitochondrial intermembrane space. In some embodiments, a mitochondrial presequence comprises an N-terminal extension that is an alpha-helical segment with net positive charge a length between 15 and 55 amino acids. However, the greater part of mitochondrial proteins residing in the outer membrane, intermembrane space and inner membrane lack the classical presequence, but rather contain internal cryptic targeting sequences within the mature protein. In some embodiments, the mitochondrial localization sequence is recognized by the TOM complex. In some embodiments, the mitochondrial protein is further transplanted into the mitochondrial outer membrane with the help of a TIM chaperone or mitochondrial outer membrane insertase. In some embodiments, the mitochondrial protein is further transported into the mitochondrial intermembrane space by the mitochondrial intermembrane space import and assembly machinery. In some embodiments, the mitochondrial protein is further transported into the TIM23 complex into the mitochondrial matrix or inner membrane. In some embodiments, the mitochondrial protein is further transported into the TIM22 complex into the mitochondrial matrix or inner membrane.

In some embodiments, protein targeting to the peroxisome is through peroxisome localization sequence (also known as a peroxisome targeting signal) that enables translocation into the peroxisome. There are two main classes of peroxisome localization sequences. Peroxisome targeting signal 1 is characterized by a c-terminal tripeptide with a consensus sequence (S/A/C)-(K/R/H)-(L/A). The common is serine-lysine-leucine (SKL). Peroxisome targeting sequence 2 is characterized by a nonapeptide located near the N-terminus with a consensus sequence (R/K)-(L/V/I)-XXXXX-(H/Q)-(L/A/F) where X is any amino acid. Some proteins contain neither of these signals and their transport is based on association with a protein that does contain a peroxisomal targeting signal. In some embodiments the peroxisome localization sequence interacts with a PEX gene. In some embodiments the peroxisome localization sequence interacts with the PTS1 receptor encoded by the PEX5 gene. In some embodiments the peroxisome localization sequence interacts with the PTS2 receptor encoded by the PEX7 gene. In some embodiments the peroxisomal localization sequence is a "mPTS" motif, which is more poorly defined and may consist of discontinuous subdomains. One of these usually is a cluster of basic amino acids (arginines and lysines) within a loop of protein (i.e., between membrane spans) that will face the matrix.

In some embodiments, a membrane protein payload agent comprises an in-frame fusion of a protein of interest to the coding sequence of a transmembrane protein, or an in-frame fusion of a protein of interest to the transmembrane domain or membrane-anchoring domain of a protein (e.g. fusion to the transferrin receptor membrane anchor domain). See, e.g., Winndard, P, et al. Development of novel chimeric transmembrane proteins for multimodality imaging of cancer cells, Cancer Biology & Therapy. 12:1889-1899 (2007).

In some embodiments a sorting signal or signal peptide is appended to the N or C terminus of a protein (e.g., membrane protein or secreted protein). See Goder, V. & Spiess, M., Topogenesis of membrane proteins: determinants and dynamics. FEBS Letters. 504(3): 87-93 (2001). In some embodiments the protein is a natural protein. In some embodiments the membrane protein is a synthetic protein.

In some embodiments, a mitochondrial or peroxisome protein payload agent comprises an in-frame fusion of a protein of interest to the coding sequence of a mitochondrial or peroxisome protein, or an in-frame fusion of a protein of interest to the mitochondrial or peroxisome localization sequence of a protein.

In some embodiments a mitochondrial or peroxisome localization sequence is appended to the N or C terminus of a protein (e.g., mitochondrial or peroxisome protein). In some embodiments the protein is a natural protein. In some embodiments the mitochondrial or peroxisome protein is a synthetic protein.

In some embodiments, a signal emerges from a ribosome only after translation of a transcript has reached a stop codon. In some embodiments insertion of a membrane protein is post-translational.

In some embodiments a signal sequence is selected from Table 6. In some embodiments a signal sequence comprises a sequence selected from Table 6. In some embodiments a signal sequence of Table 6 may be appended to the N-terminus of a protein, e.g., a membrane protein or secreted protein. In some embodiments a signal sequence of Table 6 may be appended to the C-terminus of a protein, e.g., a membrane protein or secreted protein. A person of ordinary skill will appreciate that the signal sequences below are not limited for use with their respective naturally associated proteins.

TABLE 6

Exemplary signal sequences.

| Signal Sequence | Naturally Associated Protein | Location Associated Protein is Directed | SEQ ID NO |
|---|---|---|---|
| MRVKEKYQHL WRWGWKWGTM LLGILMICSA TE | HIV-1gp41 | Plasma membrane | 1 |
| CAAL | p21ras | Plasma membrane | 2 |
| KKKKKK | p21ras | Plasma membrane | 3 |
| RRRRR | p21ras | Plasma membrane | 4 |
| MRLLLALLGV LLSVPGPPVL S | FGFR4 | Plasma membrane | 5 |
| CSIMNLMCGS TC | ROP7 GTPase | Plasma membrane | 6 |
| GHKSEEKREK MKRTLLKDWK TRLSYFLQNS STPGKPKTGK KSKQQ | RGS2 | Plasma membrane | 7 |
| RSTLKLTTLQ CQYSTVMD | LHR | Plasma membrane\ basolateral cell surface | 8 |
| RQGLHNMEDV YELIENSH | TSHR | Plasma membrane\ basolateral cell surface | 9 |
| MDCRKMARFS YSVIWIMAIS KVFELGLVAG | TDGF1 | Plasma membrane | 10 |
| MPAWGALFLL WATAEA | (GP)IX | Plasma membrane | 11 |
| RDYR | VPAC2 | Plasma membrane | 12 |
| KMALRVALNN KQSGQITVKT SSSDHLSLAI AGLVPIALSI YQKFKPGVSP SYSIY | Toc159 | Plasma membrane | 13 |
| MGSKIVQVFL MLALFATSAL A | Classical arabinogalactan protein 4 | Plasma membrane | 14 |
| MNSKAMQALI FLGFLATSCL A | Classical arabinogalactan protein 2 | Plasma membrane | 15 |
| MGAAASIQTTVN | L1R | Plasma membrane | 16 |
| SVM | GTP-binding protein Rheb | Plasma membrane | 17 |
| FALLGTHGAS G | CD147 | Plasma membrane | 18 |

TABLE 6-continued

| Exemplary signal sequences. | | | |
|---|---|---|---|
| Signal Sequence | Naturally Associated Protein | Location Associated Protein is Directed | SEQ ID NO |
| RRRTFLK | PlcH | Plasma membrane | 19 |
| MGGKWSKSSV | Nef | Plasma membrane | 20 |
| DDPERE | Nef | Plasma membrane | 21 |
| EEANTGENNS LLHPMS | HIV-1 NA7 | Plasma membrane | 22 |
| SRRGLV | DmsA | Plasma membrane | 23 |
| SRRRFL | TorA/TorA-MalE | Plasma membrane | 24 |
| SRRQFI | SufI | Plasma membrane\ periplasm | 25 |
| QRRDFL | YacK | Plasma membrane\ periplasm | 26 |
| MNKIYSIKYS AATGGLIAVS ELAKKVICKT NRKISAALLS LAVISYTNII YA | Pet (Serine protease pet autotransporter) | Plasma membrane | 27 |
| MNPNQKIITI GSICMVIGIV SLMLQIGNII SIWVSHSIQT | Influenza A Neuraminidase | Plasma Membrane | 28 |
| LRCLACSCFR TPVWPR | prRDH | Plasma Membrane | 29 |
| MGCGCSSHPE | Lck | Plasma Membrane | 30 |
| MPFVNKQFN | BoNT/A-LC | Plasma Membrane | 31 |
| DEQNAKNAAQ DRNSNKSSKG FFSKLGCC | Yck2p | Plasma Membrane | 32 |
| MLCCMRRTKQ | GAP-43 | Plasma Membrane | 33 |
| VTNGSTYILV PLSH | FSHR | Plasma Membrane | 34 |
| AETENFV | M3 mAChR | Plasma Membrane | 35 |
| RARHRRNVDR VSIGSYRT | pIgR | Plasma Membrane | 36 |
| YEDQ | RhBG | Plasma Membrane | 37 |
| LLVTSLLLCELPHPAFL IP | GM-CSF Receptor (GM_CSFR) | Plasma membrane | 38 |
| DSWGILFSHP | Prdx6 | Lysosome | 39 |
| [DE]x{3}L[LI] | OCA2/GLUT8/p40/ ZIP1 | Lysosome\ Melanosome | 40 |
| DETQPLLI | OCA2/GLUT8/p40/ ZIP1 motif | Lysosome\ Melanosome | 605 |

TABLE 6-continued

Exemplary signal sequences.

| Signal Sequence | Naturally Associated Protein | Location Associated Protein is Directed | SEQ ID NO |
|---|---|---|---|
| Ex{3}LL | GLUT8 | Lysosome | 41 |
| ETQPLL | GLUT8 motif | Lysosome | 606 |
| EEEx{8}LI | CLN3 | Lysosome | 42 |
| EEEAESAARQPLI | CLN3 motif | Lysosome | 607 |
| YTPL | HLA-DM/CD8 | Lysosome | 43 |
| NQPLLT | gp-75 | Lysosome\ Melanosome | 44 |
| RRPGQRRPPP PPPPPPLPPP PPPPPLPPLP LPPL | FasL | Lysosome | 45 |
| RGQGSMDEGT ADERAPLIRT | Limp II | Lysosome | 46 |
| Yx{2}[VILF WCM] | LAMP1/Ptc1/ Endocytosed GalR1/ CLN7/tyrosinase/ SPPL2a | Lysosome | 47 |
| EKITLL | Insulin receptor | Lysosome | 48 |
| SSLKILSKG | CXCR4 | Lysosome\ Endosome | 49 |
| PNQALLRILK ETEFKKIKVL GSG | EGF receptor | Lysosome | 50 |
| YLLNT | Nramp2 | Lysosome | 51 |
| YGSI | Nramp1 (Slc11a1) | Lysosome | 52 |
| GYDQL | Cystinosin | Lysosome | 53 |
| YFPQA | Cystinosin | Lysosome | 54 |
| LLDLLDE | C1C-3 | Lysosome\ Endosome | 55 |
| LKQETEVELY NEFPEPMKLD KN | rab7 | Lysosome\ Endosome | 56 |
| RRRAVVKEPL LPPEDDTRDN | E-cadherin | Lysosome | 57 |
| PGYRHV | LAP | Lysosome | 58 |
| GYx{2}I | lgp120 | Lysosome | 59 |
| GTEKCVWGPS YWCQNME | prosaposin | Lysosome | 60 |
| Kx{3}Q | ARD1 | Lysosome | 61 |
| KLMDQ | ARD1 motif | Lysosome | 608 |
| EQEPLL | CLN7 | Lysosome | 62 |
| YPAF | LAPTM4 | Lysosome | 63 |
| YEMA | LAPTM4 | Lysosome | 64 |
| GYx{2}[VIL FWCM] | Cystinosis | Lysosome | 65 |
| SLLKGRQGIY | OA1 | Lysosome\ Melanosome | 66 |
| ETERLL | Mucolipin-1 | Lysosome | 67 |

TABLE 6-continued

Exemplary signal sequences.

| Signal Sequence | Naturally Associated Protein | Location Associated Protein is Directed | SEQ ID NO |
|---|---|---|---|
| EEHSLL | Mucolipin-1 | Lysosome | 68 |
| DDSDEDLL | mannose 6-phosphate/ insulin-like growth factor II receptor | Lysosome | 69 |
| EQERLL | p40 | Lysosome | 70 |
| CINCCKVL | RhoB | Lysosome | 71 |
| EFFDAx{1}E | Opi1p | Endoplasmic Reticulum | 72 |
| Dx{1}E | VSV-G/GONST1/ CASP | Endoplasmic Reticulum | 73 |
| DIE | VSV-G/GONST1/ CASP motif | Endoplasmic Reticulum | 609 |
| SKK | FV glycoprotein | Endoplasmic Reticulum | 74 |
| MAGARRGWRL APVRRGVCGP RARPLMRPLW LLFAVSFFGW TGALDG | NHE6 | Endoplasmic Reticulum | 75 |
| MGSLWSKISQ LFVDA | E protein (PRRSV) | Endoplasmic Reticulum | 76 |
| MRVKEKYQHL WRWGWRWGTM LLGMLMIC | p-gp160 (HIV-1 envelope protein) | Endoplasmic Reticulum | 77 |
| MRLSWFRVLT VLSICLSAVA T | FKBP-13 | Endoplasmic Reticulum | 78 |
| MDPVVVLGLC LSCLLLLSLW KQSYGGGKL | P450 2C1 | Endoplasmic Reticulum | 79 |
| HALSYWKPFL VNMCVATVLT AGAYLCYRFL FNSNT | PTP-1B | Endoplasmic Reticulum | 80 |
| SPRGSRPSWG PTDPRRRSRN LGKVIDTLTC GFADLMGYIP LVGA | hepatitis C virus glycoprotein E1 | Endoplasmic Reticulum | 81 |
| MALWMRFLPL LALLVLWEPK PAQA | proinsulin | Endoplasmic Reticulum | 82 |
| MEAMWLLCVA LAVLAWG | GlcNAc-PI | Endoplasmic Reticulum | 83 |
| IPHDLCHNGE KSKKPSKIKS LFKKKSK | STIM2 | Endoplasmic Reticulum | 84 |
| RPSNNNTTTT TTTDATQPHH HHHHHRHRDA GVKNVTNNSK TTESSSSSSA AKEKPKHKKG LLHKLKKKL | Ist2 | Endoplasmic Reticulum | 85 |
| [HK]x{1}K | p11/TASK-1 | Endoplasmic Reticulum | 86 |
| VVQAITFIFK SLGLKCVQFL | mTOR | Endoplasmic Reticulum | 87 |

TABLE 6-continued

| Signal Sequence | Naturally Associated Protein | Location Associated Protein is Directed | SEQ ID NO |
|---|---|---|---|
| Exemplary signal sequences. | | | |
| PQVMPTFLNV IRVCDGAIRE | | | |
| TFCSTALLIT ALALVCTLLY L | E3/19K (adenovirus) | Endoplasmic Reticulum | 88 |
| GVMLGSIFCA LITMLGHI | Cosmc | Endoplasmic Reticulum | 89 |
| FLAAFVVMLC ITIVTIVVYI YLV | gp36.5/m164 | Endoplasmic Reticulum | 90 |
| WGVLAGIAYF SMVGNWAKVL VVLLLFAGV | E1 (HCV) | Endoplasmic Reticulum | 91 |
| KKSQ | Tapasin (tpn) | Endoplasmic Reticulum | 92 |
| WWQLTLGAIC ALPLAGLLAC CA | E1 (Rubella virus) | Endoplasmic Reticulum | 93 |
| Yx{4}LL | B5R envelope protein | Golgi | 94 |
| Lx{2}KN | ABCA | Golgi (early post-Golgi comparments) | 95 |
| LLWKN | ABCA motif | Golgi (early post-Golgi comparments) | 610 |
| CPSDSEEDEG | Furin | Golgi | 96 |
| YKGL | Furin | Golgi | 97 |
| MAKTAMAYKE KMKELSMLSL ICSCFYPEPR NINI | SCG10 | Golgi | 98 |
| YAGL | gpI | Golgi | 99 |
| DDFEDSESTD TEEE | gpI | Golgi | 100 |
| MASPGSGFWS FGSEDGSGDS ENPGTAR | GAD65 | Golgi | 101 |
| QV[SA]PA | rhodopsin | Golgi | 102 |
| RLLDSSNATW QRDQPDTHRL SRLDAHVMSM | G1 membrane glycoprotein | Golgi | 103 |
| WEK[IM]x{2 }FF | SopD2 | Golgi | 104 |
| YKNL | ARD1 (ARF domain) | Golgi | 105 |
| YEGL | ARD1 (ARF domain) | Golgi | 106 |
| MKFREPLLGG SAAMPGASLQ RACRLLVAVC ALHLGVTLVYYLA | "beta-1,4-GT" | Golgi | 107 |
| MKELTMLSLS FFFVSALLAA AANPLLSAA | miraculin (STI) | Secretory Pathway | 108 |
| MRISKPHLRS ISIQCYLCLL LNSHFLTEAG IHVFILGCFS AGLPKTEA | IL-15 (LSP) | Secretory Pathway | 109 |

TABLE 6-continued

| Exemplary signal sequences. | | | |
|---|---|---|---|
| Signal Sequence | Naturally Associated Protein | Location Associated Protein is Directed | SEQ ID NO |
| MNKIYSLKYS HITGGLIAVS ELSGRVSSRA TGKKKHKRIL ALCFLGLLQS SYSFA | EspP (*E. coli* autotransporter) | Secretory Pathway | 110 |
| MARQGCLGSF QVISLFTFAI SVNICLG | ENPP2 | Secretory Pathway | 111 |
| MQRARPTLWA AALTLLVLLR GPPVARA | IGFBP3 | Secretory Pathway | 112 |
| MKSVYFVAGL FIMLAQGSWQ | proglucagon | Secretory Pathway | 113 |
| MNIKKFAKQA TVLTFTTALL AGGATQAFA | Levansucrase | Secretory Pathway | 114 |
| MQQDGTQQDR IKQSPAPLNG MSRRGFLGGA GTLALATASG LLLPGTAHA | XlnC | Secretory Pathway | 115 |
| MGSYALPRSG VRRSIRVLLL ALVVGVLGTA TALIAPPGAH A | xylanase A | Secretory Pathway | 116 |
| MNKVFKVIWC KTSQTWIAVS ELSKAFSLST TTDIPKKTKI FIAAAPLLFL SFNTNA | EmaA | Secretory Pathway | 117 |
| SDPRLRQFLQ KSK | prosomatostatin | Secretory Pathway | 118 |
| CQDLTTESNL LAC | POMC (pro-opiomelanocortin) | Secretory Pathway | 119 |
| LPTDTTTFKR IFLKRM | Prorenin | Secretory Pathway | 120 |
| HDEL | invertase enzyme | Endoplasmic Reticulum | 121 |
| KTEL | AGR2 | Endoplasmic Reticulum | 122 |
| HNEL | LRP's receptor-associatedprotein(RAP) | Endoplasmic Reticulum | 123 |
| KEDL | XP124L | Endoplasmic Reticulum (pre-golgi compartments) | 124 |
| KDEL | ERp59/PDI/ABP1 | Endoplasmic Reticulum | 125 |
| KEEL | ERp72 | Endoplasmic Reticulum | 126 |
| QEDL | ERp61 | Endoplasmic Reticulum | 127 |

In some embodiments, protein targeting to the nucleus is through a nuclear localization sequence (also known as a nuclear localization signal) that enables translocation through the nuclear envelope via nuclear pore complexes. The nuclear pore complex is composed of nucleoporins. Nucleoporins interact with transport molecules known as karyopherins. Karyophins bind to proteins containing a nuclear localization sequence and transport the protein across the nuclear pore complex. In some embodiments a nuclear localization sequence consists of one or more short (e.g., <50 amino-acid residues) sequence of basic amino acids. In some embodiments a nuclear localization sequence consists of one or more short (e.g., <50 amino-acid residues) sequence of lysines or arginines. In some embodiments the nuclear localization sequence is monopartitie or bipartite. In some embodiments the nuclear localization sequence is at the N or C terminus of a protein payload agent. In some embodiments the nuclear localization sequence is in the middle of the amino acid sequence of a protein payload agent and is exposed on the protein surface. In some embodiments a nuclear localization sequence is recognized by a karyophin. In some embodiment the nuclear localization sequence interacts with one or more karyopherin. In some embodiments the karyophin recognizes a nuclear localization sequence as it emerges from a ribosome. In some embodiments the karyophin recognizes a nuclear localization sequence on a fully translated protein.

In some embodiments, a nuclear protein payload agent comprises an in-frame fusion of a protein of interest to the coding sequence of a nuclear protein, or an in-frame fusion of a protein of interest to the nuclear localization sequence of a protein.

In some embodiments a nuclear localization sequence is appended to the N or C terminus of a protein (e.g., nuclear protein). In some embodiments the protein is a natural protein. In some embodiments the nuclear protein is a synthetic protein.

In some embodiments a nuclear localization sequence is selected from Table 6-1. In some embodiments a nuclear localization sequence comprises a sequence selected from Table 6-1. In some embodiments a nuclear localization sequence of Table 6-1 may be appended to the N-terminus of a protein, e.g., a nuclear protein. In some embodiments a signal sequence of Table 6-1 may be appended to the C-terminus of a protein, e.g., a nuclear protein. A person of ordinary skill will appreciate that the signal sequences below are not limited for use with their respective naturally associated proteins. In some embodiments, the nuclear localization sequence is defined as the nuclear localization sequence from the proteins listed in Table 6 of US 2015-0246139, which is incorporated by reference herein. In some embodiments, the nuclear localization signal has the sequence of amino acids set forth in any one of SEQ ID NOS: 128-507 and 605-626.

TABLE 6-1

Exemplary Nuclear Localization Sequences

| Signal | Reported Protein(s) | Localization | SEQ ID NO |
|---|---|---|---|
| TAKRS | Yap1 | Nucleus | 128 |
| KKKGSKTS | Yap1 | Nucleus | 129 |
| GKISKHWTGI | PLSCR1 | Nucleus | 130 |
| SYNDFGNYNN QSSNFGPMKG GNFGGRSSGP YGGGGQYFAK PRNQGGYGG | hnRNP A1 | Nucleus | 131 |
| SNFGPMKGGN FGGRSSGPY | hnRNP A1 | Nucleus | 132 |
| PPTKKIR | NUCKS | Nucleus | 133 |
| KNQKQGKGKT CKKGKK | SA2L (L for longer isoform) | Nucleus | 134 |
| KRKRGRPGRP PSTNKKPRK | SA1/STAG1 | Nucleus | 135 |
| RKRR | TWIST | Nucleus | 136 |
| KRGKK | TWIST | Nucleus | 137 |
| RKKRR | Daxx | Nucleus | 138 |
| KKSRKEKK | Daxx | Nucleus | 139 |
| RSGGNHRRNG RGGRGGYNRR NNGYHPY | Hrp1 | Nucleus | 140 |
| SKKRSLED | Ty1 Integrase | Nucleus | 141 |
| PPRSKKRI | Ty1 Integrase | Nucleus | 142 |
| KSAKISKPLH | Ste12 | Nucleus | 143 |
| KNKEISMP | Ste12 | Nucleus | 144 |
| KKMIEEKKAVLKRKMK | OCR-2 | Nucleus | 145 |
| NFNHIHKRIR RVADKYLSG | PI4K230 | Nucleus | 146 |

TABLE 6-1-continued

| Exemplary Nuclear Localization Sequences | | | |
|---|---|---|---|
| Signal | Reported Protein(s) | Localization | SEQ ID NO |
| CNKRKYSLN | NF-AT | Nucleus | 147 |
| GKRKK | NF-AT | Nucleus | 148 |
| EED | cytoskeletal red cell protein 4.1R | Nucleus | 149 |
| KKKRER | cytoskeletal red cell protein 4.1R | Nucleus | 150 |
| EEKRKR | NF-kB p65 | Nucleus | 151 |
| GDRRAAPARP | Maize R protein | Nucleus | 152 |
| MISEALRKAI GKR | Maize R protein | Nucleus | 153 |
| MSERKRREKL | Maize R protein | Nucleus | 154 |
| GGGx{3}KNR Rx{6}RGGRN | Nab2 | Nucleus | 155 |
| GNLDIQRPKR KRKNSRVTFS EDDEI | NIPP1 | Nucleus | 156 |
| INPEDVDPSV GRFRNMVQTA VVPVKKKRVE G | NIPP1 | Nucleus | 157 |
| GSGQIQLWQF LLELLSDSAN ASCITWEGTN GEFKMTDPDE VARRWGERKS KPNMNYDKLS RALRYYYDKN IMTKVHGKRY AYKF | Fli1 | Nucleus | 158 |
| HRKYEAPRHx {6}PRKR | L3 | Nucleus | 159 |
| HSAELALNVI TKKRKGYEDD | Cyclin H | Nucleus | 160 |
| DYVSKKSKHEEEEWTDDDLV ESL | Cyclin H | Nucleus | 161 |
| KGRKR | IGFBP-3 | Nucleus | 162 |
| KGVKRKADTT TP | BET family | Nucleus | 163 |
| KILKKRHI | cGMP-PK | Nucleus | 164 |
| KKIR | PSR | Nucleus | 165 |
| KKYR | PSR | Nucleus | 166 |
| KKKKRK | BRD2 | Nucleus | 167 |
| KKQALKEKEL GNDAYKKK | mSTI1/Hop | Nucleus | 168 |
| KKSTALSREL GKIMRRR | Mcm10 | Nucleus | 169 |
| KKKTVINDLL HYKKEK | Mcm10 | Nucleus | 170 |
| KKx{15}KKR K | DNAhelicaseQ1 | Nucleus | 171 |
| KNLEAIVSVI AERNKKK | 5-lipoxygenase | Nucleus | 172 |
| KRKx{11}KK KSKK | hpoly(ADP)poly | Nucleus | 173 |
| KRKx{22}KE LQKQITK | HIV-1 | Nucleus | 174 |
| KRKVEDPYC | HIV-1 motif | Nucleus | 611 |
| KRKKKPYC | HIV-1 motif | Nucleus | 612 |
| KRQQLKENNK LRR | dHSF | Nucleus | 175 |
| KRVAKRKLIE QNRERRRK | Thyroid hormone receptor(TR) | Nucleus | 176 |
| KRx{9}KTKK | NP of Thogoto virus | Nucleus | 177 |

TABLE 6-1-continued

| Exemplary Nuclear Localization Sequences | | | |
|---|---|---|---|
| Signal | Reported Protein(s) | Localization | SEQ ID NO |
| KSKKQK | Chicken v-rel | Nucleus | 178 |
| KSRKRKL | v-jun | Nucleus | 179 |
| KTLETVPLER KKREK | RNP B1 | Nucleus | 180 |
| KVLKKRRL | IL-1a | Nucleus | 181 |
| Kx{2}Kx{16 }Kx{2}K | Ror1 | Nucleus | 182 |
| KIYKG HLYLPGMDHA QLVAIKTLK | Ror1 motif | Nucleus | 613 |
| "Lx{30}R{1,3}x{55}R{1,3}" | cytotoxic ribonuclease | Nucleus | 183 |
| NKIPIKDLLN PQ | MATa2 | Nucleus | 184 |
| MEQRGQNAPA ASGARKRHGP GPREARGARP GPRVPKTLVL VVAAVLLLVS AESA | TNFRSF10B | Nucleus | 185 |
| MGTLYARHVN AGSTGPIKST IRIYFKPKHV KAWIPRPPRL CQYEKAKNVN FQPSGVTTTR QSI | VP1 capsid protein (CVB3) | Nucleus | 186 |
| CNGCRNMLLY PRGATNVCCA LC | PsLSD1 | Nucleus | 187 |
| CANCRTTLMY PYGAPSVKCA VC | PsLSD1 | Nucleus | 188 |
| CGGCRTLLMY TRGATSVRCS CC | PsLSD1 | Nucleus | 189 |
| MVQLRPRASR | NOL7 | Nucleus | 190 |
| KRFKRRWMVR KMKTKK | NOL7 | Nucleus | 191 |
| RRDKTLLKEK RKRREELFIE QKKRK | NOL7 | Nucleus | 192 |
| NYKKPKL | hFGF-1a/b | Nucleus | 193 |
| PDGKRKRK | TR?1 | Nucleus | 194 |
| PEEVKKRKKA V | Cofilin | Nucleus | 195 |
| PKKKSRKSS | Basonuclin | Nucleus | 196 |
| PKRRTARKQL PKR | h DNA ligase I | Nucleus | 197 |
| PLKRKKL | CDC6 | Nucleus | 198 |
| PPx{2}R | Sam68 | Nucleus | 199 |
| PPTVR | Sam68 | Nucleus | 614 |
| PRPR VP22 | bovine herpesvirus 1 | Nucleus | 200 |
| REKKKFLKRR | Mx1 (mouse) | Nucleus | 201 |
| REKKRQFEMK RKLH | phosphatase inhibitor 2 (Inh2) | Nucleus | 202 |
| RESGKKRKRK RLKPT | PDGF-A | Nucleus | 203 |
| RKCSQTQCPR KVIK | PML | Nucleus | 204 |
| RKRKLPCDTP GQGLTCSGEK RRR | RAC3 | Nucleus | 205 |
| RKRPVRRR | FGF | Nucleus | 206 |

TABLE 6-1-continued

| Exemplary Nuclear Localization Sequences | | | |
|---|---|---|---|
| Signal | Reported Protein(s) | Localization | SEQ ID NO |
| RKx{10}RKx {10}KK | glucocorticoid receptor | Nucleus | 207 |
| RLKKLKCSKx {19}KTKR | GAL4 | Nucleus | 208 |
| RLKKLK CSKEKPKCAK CLKNNWECRY SPKTKR | GAL4 | Nucleus | 615 |
| RLRRDAGGRG GVYEHLGGAP RRRK | FGF3 | Nucleus | 209 |
| GKGRPRRGFK TRRTQKSS | FGF3 | Nucleus | 210 |
| RRERx{4}RP RKIPR | BDV-P | Nucleus | 211 |
| RRGLKR | SRF | Nucleus | 212 |
| RRKRQR | Dorsal | Nucleus | 213 |
| RRKRR | TTF-1 | Nucleus | 214 |
| RRRGL | Angiogenin | Nucleus | 215 |
| RRRR | EBV gp110 | Nucleus | 216 |
| RSRARSASLG TTTQGWDPPP LRRPSRARRR | cytomegalovirus kinase pUL97 | Nucleus | 217 |
| RGGRKRPLRP PLVSLARTPL CRRR | cytomegalovirus kinase pUL97 | Nucleus | 218 |
| RVTIRTVRVR RPPKGKHRK | PDGF-B | Nucleus | 219 |
| [ST]Px{1}K R[LI] | Cdc6 | Nucleus | 220 |
| SGVVLPSTGV VKSSGGGGGG DSDHSDLEAS VVKEAESSRV VDPEKRPRKR GRKPANG | CrMYC2 | Nucleus | 221 |
| DVKIIGREAM IRVQSSKNNH PAARVMGALK DLDLEL | CrMYC2 | Nucleus | 222 |
| GREEPLNHVE AERQRREKLN QRFYALRAVV PNVSKMDKAS LLGDAISYIN ELKAK | CrMYC2 | Nucleus | 223 |
| SHAAGSKQHE SIPGKAKKPK VKKKEKGKKE KGKKKEAPH | H2RSP | Nucleus | 224 |
| SKLCLGWLWG M | Hepatitis B virus core protein | Nucleus | 225 |
| TKKQKT | prothymosin alpha | Nucleus | 226 |
| VRILESWFAK NIENPYLDT | Matalpha2 | Nucleus | 227 |
| VRVNVKREYD HMNGSRESPV DCSVSKCNKL VGGGEANPMN YNSYMDEKNG PPPPNMTTNE RRVIV | Fli1 | Nucleus | 228 |
| YHYGLLTCES CKGFFKRTVQ NQKRYTCIEN QNCQIDKTQR KRCPYCRFKK CI | LRH1 | Nucleus | 229 |
| DVGMKLEAVR ADRMRGGRNK FGPMYKRDRA LKQQKK | LRH1 | Nucleus | 230 |
| YNDFGNYNNQ SSNFGPMKGG NFGGRSSGPY | hnRNP A1 | Nucleus | 231 |
| LRLTLLELVR RLNGNG | Borna Disease Virus p10 | Nucleus | 232 |
| RRRKVEAGRT KLAHFRQRKT KGDSSHSEKK TAKRK | Pericentrin | Nucleus | 233 |

TABLE 6-1-continued

Exemplary Nuclear Localization Sequences

| Signal | Reported Protein(s) | Localization | SEQ ID NO |
|---|---|---|---|
| RRRHIVRKRT LRR | EGFR/ErbB2/ErbB3/ ErbB4 | Nucleus | 234 |
| KRRQQKIRKY TMRR | ErbB2 | Nucleus | 235 |
| RRWKEELDEE LQRKR | NPK1 | Nucleus | 236 |
| KKLKKKK | SMAD1 | Nucleus | 237 |
| KKYIDGQKKK CGEERRRV | IL-5 | Nucleus | 238 |
| RKRKL | SRC-3 | Nucleus | 239 |
| KRRR | SRC-3 | Nucleus | 240 |
| KRSAEGGNPP KPLKKLR | p110RB1 | Nucleus | 241 |
| PKKLRPP | IGFBP-2 | Nucleus | 242 |
| RRx{26}RKG FYKRKQCKPS RGRKRG | IGFBP-5 | Nucleus | 243 |
| RRHMEASL QELKASPRMV PRAVYLPNCD RKGFYKRKQC KPSRGRKRG | IGFBP-5 motif | Nucleus | 616 |
| EGKVTKRKHD NEGSGSKRPK V | Ku70 | Nucleus | 244 |
| Rx{11}HRGF YRKRQCRSSQ GQRRG | IGFBP-6 | Nucleus | 245 |
| R GAQTLYVPNC DHERGFYRKRQ CRSSQGQRRG | IGFBP-6 | Nucleus | 617 |
| PEKKKEKQEK K | UL84 | Nucleus | 246 |
| GRKKRRQRRR A | HIV-1 Tat | Nucleus | 247 |
| MRKTKLAPT | FMDV 3D | Nucleus | 248 |
| SHSSMAKRAK KESQDFI | RecQ5 | Nucleus | 249 |
| AVEGKPLSRA AQLRERRKDL HVSGKPSPRY ALKKRALEAK KNK | CT311 | Nucleus | 250 |
| SGYGKVSRRG GHQNSYKPY | hnRNP D | Nucleus | 251 |
| RDRGYDKADR EEGKERRHHR REELAPY | PQBP-1 | Nucleus | 252 |
| GEGERPAQNE KRKEKNIKRG GNRFEPYANP TKR | hnRNP M | Nucleus | 253 |
| FKSSQEEVRS YSDPPLKFMS VQRPGPY | hnRNP F | Nucleus | 254 |
| SPS | Egr-1 | Nucleus | 255 |
| [RK]x{2}Lx {1}[VY]x{2} [VI]x{1}[KR]x{3}[KR ] | Asr1p (recognized by five yeast importins) | Nucleus | 256 |
| KKKRKR | Ire1p | Nucleus | 257 |
| KRGSRGGKKG RK | Ire1p | Nucleus | 258 |
| KKGR | Ire1p | Nucleus | 259 |
| KHSQSRR | Pin1 | Nucleus | 260 |
| KNRRAKCRQQ R | Crx | Nucleus | 261 |
| KPNKRK | HDGF | Nucleus | 262 |

TABLE 6-1-continued

| Exemplary Nuclear Localization Sequences | | | |
|---|---|---|---|
| Signal | Reported Protein(s) | Localization | SEQ ID NO |
| KRRAGDLLED SPKRPK | HDGF | Nucleus | 263 |
| KRRK | UL80 Proteins | Nucleus | 264 |
| RARKRLK | UL80 Proteins | Nucleus | 265 |
| KRRRER | CMV pAP | Nucleus | 266 |
| KARKRLK | CMV pAP | Nucleus | 267 |
| MEEAVTMAPA AVSSAVVGDP MEYNAILRRK LEEDLE | Opaque2 (O2) | Nucleus | 268 |
| MPTEERVRKK ESNRESARRS RYRKAAHLKE L | Opaque2 (O2) | Nucleus | 269 |
| KRKGDEVDGV DEVAKKKSKK | PARP | Nucleus | 270 |
| GKKNQKHKLK M | plant potyviral NIa | Nucleus | 271 |
| KRKGTTRGMG AKSRKFINMY GFDPTDFSYI | plant potyviral NIa | Nucleus | 272 |
| KKQRYMEIQE TLKK | NPR1 | Nucleus | 273 |
| KRK | AIRE (Autoimmune regulator)/MSH6 | Nucleus | 274 |
| FKRKHKKDIS QNKRAVRR | HSP70 | Nucleus | 275 |
| KRKx{8}KKx {1}K | VP1 capsid protein (simian virus 40) | Nucleus | 276 |
| MAPKRRRRRK | VP1 capsid protein (simian virus 40) motif | Nucleus | 618 |
| NVRQLLSGEQ GADILMVQEA GSLPSSAVRT SRVIQHGGTP IEEYTWNLGT RSRPNMVYIY YSRLDVGANR VNLAIVS | CDTB | Nucleus | 277 |
| KKRR | MSH6/BRCA2 | Nucleus | 278 |
| RKRKR | MSH6 | Nucleus | 279 |
| KRPR | hEXO1 | Nucleus | 280 |
| RKQVSSHIQV LARRKLR | TEA/ATTS protein scalloped | Nucleus | 281 |
| KRCFKKGAR | BPV-1 E2 | Nucleus | 282 |
| KCYRFRVKKN HRHR | BPV-1 E2 | Nucleus | 283 |
| RPRK | HPV type 16 E6 | Nucleus | 284 |
| KQRHLDKKQR | HPV type 16 E7 | Nucleus | 285 |
| KCLKFYSK | HPV type 16 E8 | Nucleus | 286 |
| KRKKRK | HPV16 L1 | Nucleus | 287 |
| KRKx{12}KR | HPV16 L1 | Nucleus | 288 |
| KRKKRK | HPV16 L1 motif | Nucleus | 619 |
| LKCLRYRFKK H | HPV16 E2 | Nucleus | 289 |
| KRPRSPSS | EBNA-1 | Nucleus | 290 |
| KRKVLGSSQN SSGSEASETP VKRRK | bovine papillomavirus type 1 E1 | Nucleus | 291 |

TABLE 6-1-continued

| Exemplary Nuclear Localization Sequences | | | |
|---|---|---|---|
| Signal | Reported Protein(s) | Localization | SEQ ID NO |
| PDRKRLRK | U69 protein kinase (HHV-6) | Nucleus | 292 |
| PRGSGPRRAA ST | VP19C (HSV-1) | Nucleus | 293 |
| RRKTTPSYSG QYRTARR | ORF9 (VZV) | Nucleus | 294 |
| ARRPSCSPEQ HGGKVARLQP PPTKAQPA | ICP27 (HSV-1 type 1) | Nucleus | 295 |
| RGGRRGRRRG RGRGG | ICP27 (HSV-1 type 1) | Nucleus | 296 |
| PAAKRVKLD | c-myc | Nucleus | 297 |
| RQRRNELKRS | c-myc | Nucleus | 298 |
| MHGDTPTLHE YMLDLQPETT DLYCYEQLSD SSEEEDE | HPV16 E7 | Nucleus | 299 |
| MRHKRSAKRT KR | HPV16 L2 | Nucleus | 300 |
| RKRRKR | HPV16 L2 | Nucleus | 301 |
| IASRRGLVRY SRIGQRGSMH | L2(human papillomavirus type 6B) | Nucleus | 302 |
| MNKIPIKDLL NPQ | repressor alpha 2 | Nucleus | 303 |
| VRILESWFAK NIENPY | repressor alpha 3 | Nucleus | 304 |
| GRRKAAKRKW AAQ | Nuclear myosin I (NM1) | Nucleus | 305 |
| KKRKRR | Nk2.2 | Nucleus | 306 |
| RYKMKRAR | Nk2.2 | Nucleus | 307 |
| RGRKSSGFPK SVKSR | 5-lipoxygenase (5-LO) | Nucleus | 308 |
| LRDGRAKLAR D | 5-lipoxygenase | Nucleus | 309 |
| KCHKDLPR | 5-lipoxygenase | Nucleus | 310 |
| ARKRKPSP | IRF2BP2 | Nucleus | 311 |
| REPADLEMNL TVPVRR | CDT | Nucleus | 312 |
| RRTQISSDHF PVGVSRR | CDT | Nucleus | 313 |
| RSKR | BLM | Nucleus | 314 |
| RRPALRSPPL GTRKRK | ICP22 | Nucleus | 315 |
| DIPPRPKRAR VNLR | ICP22 | Nucleus | 316 |
| PIKKK | BRCA2 | Nucleus | 317 |
| GSIIRKWN | hPLSCR4 | Nucleus | 318 |
| KRKx{18}KR RKx{3}KRR | BPV1 E1 | Nucleus | 319 |
| FDYTPNSKRQ RCGM | U27 (HHV-7) | Nucleus | 320 |
| KKKKKEEEGE GKKK | act/inh betaA | Nucleus | 321 |
| KRPRP | adenovE1a | Nucleus | 322 |
| RGRRRRQR | Amida | Nucleus | 323 |
| RKRRR | Amida | Nucleus | 324 |
| PPRIYPQLPS APT | BDV-P | Nucleus | 325 |
| PRPRKIPR | BDV-P | Nucleus | 326 |

TABLE 6-1-continued

| Exemplary Nuclear Localization Sequences | | | |
|---|---|---|---|
| Signal | Reported Protein(s) | Localization | SEQ ID NO |
| HSHKKKKIRT SPTFRRPKTL RLRRQPKYPR KSAPRRNKLD HY | BIB | Nucleus | 327 |
| PKKNRLRR | BRCA1 | Nucleus | 328 |
| KRKRRP | BRCA1 | Nucleus | 329 |
| RRRx{11}KR RK | CBP80 | Nucleus | 330 |
| RRRHSDEN DGGQPIIKRRK | CBP80 motif | Nucleus | 620 |
| SKRVAKRKL | c-erb-A | Nucleus | 331 |
| RRERNKMAAA KCRNRRR | cFOS | Nucleus | 332 |
| KRMRNRIAAS KCRKRKL | cJUN | Nucleus | 333 |
| PLLKKIKQ | c-myb | Nucleus | 334 |
| PAKRARRG | VP1 (CPV) | Nucleus | 335 |
| KVNSRKRRKE VPGPNGATEE D | CTP | Nucleus | 336 |
| LKDVRKRKLG PGH | DNAseEBV | Nucleus | 337 |
| YKRPCKRSFI RFI | DNAseEBV | Nucleus | 338 |
| KKEKKKSKK | dyskerin | Nucleus | 339 |
| GKKRSKA | H2B | Nucleus | 340 |
| RAIKRRPGLD FDDDGEGNSK FLR | ARNT | Nucleus | 341 |
| RKRKKMPASQ RSKRRKT | BLM | Nucleus | 342 |
| KRPACTLKPE CVQQLLVCSQ EAKK | cytidine deaminase | Nucleus | 343 |
| PRGRRQPIPK ARQP | HCV | Nucleus | 344 |
| PRRGPR | HCV | Nucleus | 345 |
| KKSKKGRQEA LERLKKA | DNA pol alpha (human) | Nucleus | 346 |
| RKEWLTNFME DRRQRKL | Topo II (human) | Nucleus | 347 |
| KKQTTLAFKP IKKGKKR | Topo II (human) | Nucleus | 348 |
| RKCLQAGMNL EARKTKK | Glucocorticoid | Nucleus | 349 |
| GKKKYKLKH | HIV-1 | Nucleus | 350 |
| KKKYKLK | HIV1422 | Nucleus | 351 |
| KSKKKAQ | HIV1423 | Nucleus | 352 |
| RQARRNRRRR WR | HIV-1Rev | Nucleus | 353 |
| KRAAEDDEDD DVDTKKQK | prothymosin alpha | Nucleus | 354 |
| RRKGKEK | Huntington disease protein | Nucleus | 355 |
| RRSMKRK | hVDR | Nucleus | 356 |
| RKRAFHGDDP FGEGPPDKK | ICP-8 | Nucleus | 357 |
| MAPSAKATAA KKAVVKGTNG KKALKVRTSA TFRLPKTLKL AR | L25 | Nucleus | 358 |

TABLE 6-1-continued

Exemplary Nuclear Localization Sequences

| Signal | Reported Protein(s) | Localization | SEQ ID NO |
|---|---|---|---|
| KTRKHRG | L29 (ribosomal protein) | Nucleus | 359 |
| KHRKHPG | L29 | Nucleus | 360 |
| KKKKRKREK | LEF-1 | Nucleus | 361 |
| NQSSNFGPMK GGNFGGRSSG PYGGGGQYFA KPRNQGGY | M9 | Nucleus | 362 |
| YNNQSSNFGP MKGGN | M9 | Nucleus | 363 |
| MNKIPIKDLL NPG | Mat-alpha | Nucleus | 364 |
| PQSRKKLR | Max | Nucleus | 365 |
| KRQRx{20}K KSKK | Mitosin | Nucleus | 366 |
| VNEAFETLKR C | MyoD | Nucleus | 367 |
| CKRKTTNADR RKA | MyoD | Nucleus | 368 |
| QRKRQK | NF-kB | Nucleus | 369 |
| HRIEEKRKRT YETFKSI | NF-kB | Nucleus | 370 |
| PPQKKIKS | N-myc | Nucleus | 371 |
| Sx{1}GTKRS Yx{2}M | NPI-1 | Nucleus | 372 |
| TKRSx{3}M | NPI-3 | Nucleus | 373 |
| PPRKKRTVV | NS5A | Nucleus | 374 |
| KRKKEMANKS APEAKKKK | Nucleolin | Nucleus | 375 |
| KRx{10}KKK L | Nucleoplasmin | Nucleus | 376 |
| KRPAATKKAG QAKKKK | Nucloplasmin | Nucleus | 377 |
| PQPKKKP | p53-(NLS2) | Nucleus | 378 |
| KRx{7,9}PQ PKKKP | p53-(NLS1) | Nucleus | 379 |
| KRALPN NTSSSPQPKK KP | p53-(NLS1) motif | Nucleus | 621 |
| RIRKKLR | p54 | Nucleus | 380 |
| LKRKLQR | Pax-QNR | Nucleus | 381 |
| RRMKWKK | PDX-1 | Nucleus | 382 |
| KVTKNKS | Pho4 | Nucleus | 383 |
| KRRGKPGP | Pho4 | Nucleus | 384 |
| PYLNKRKGKP | Pho4p | Nucleus | 385 |
| PKKARED | polyoma virus large-T | Nucleus | 386 |
| VSRKRPR | polyoma virus large-T | Nucleus | 387 |
| APKRKSGVSK C | polyomaVP1 | Nucleus | 388 |
| EEDGPQKKKR RL | polyomaVP2 | Nucleus | 389 |
| TEKK[QG]KS ILYD | Hsc3 (proteasomal) | Nucleus | 390 |
| REKKEKEQKE K | Hsc9 (proteasomal) | Nucleus | 391 |
| LEKKVKKKFD W | Hsc iota (proteasomal) | Nucleus | 392 |
| YLTQETNKVE TYKEQPLKTP GKKKKGKP | PTHrP | Nucleus | 393 |
| RVHPYQR | QKI-5 | Nucleus | 394 |

TABLE 6-1-continued

Exemplary Nuclear Localization Sequences

| Signal | Reported Protein(s) | Localization | SEQ ID NO |
|---|---|---|---|
| SDREDGNYCP PVKRERTS | RanBP3 | Nucleus | 395 |
| KKKRERLD | RCP | Nucleus | 396 |
| MPKTRRRPRR SQRKRPPT | HTLV-1 Rex | Nucleus | 397 |
| PRRRK | SOX9 | Nucleus | 398 |
| KRPMNAFMVW AQAARRK | SOX9 | Nucleus | 399 |
| RPRRK | SRY | Nucleus | 400 |
| KRPMNAFIVW SRDQRRK | SRY | Nucleus | 401 |
| APTKRKGS | SV40(VP1) | Nucleus | 402 |
| PNKKKRK | SV40(VP2) | Nucleus | 403 |
| PKKKRKV | SV40 large T antigen | Nucleus | 404 |
| SDKKVRSRLI E | alpha (Ta) | Nucleus | 405 |
| KKKRRSREK | TCF-1 | Nucleus | 406 |
| RKRIREDRKA TTAQKVQQMK QRLNENERKR KR | TCPTP | Nucleus | 407 |
| KDCVINKHHR NRCQYCRLQR | TR2 | Nucleus | 408 |
| GRKRKKRT | Tst1/Oct6 | Nucleus | 409 |
| PKRPRDRHDG ELGGRKRARG | VirD2 (C-terminal) | Nucleus | 410 |
| EYLSRKGKLE L | VirD2 (N-terminal) | Nucleus | 411 |
| KAKRQR | v-Rel | Nucleus | 412 |
| IKYFKKFPKD | yeast SKI3 | Nucleus | 413 |
| RKRKK | yeast DNApol alpha | Nucleus | 414 |
| MASQGTKRSY EQM | vRNPs (influenza A) | Nucleus | 415 |
| KRGINDRNFW RGENGRKTR | vRNPs (influenza A) | Nucleus | 416 |
| RRMLGAPLRQ RRVR | SOCS1 | Nucleus | 417 |
| VRTTKGKRKR IDV | Lamin L1 | Nucleus | 418 |
| RSSRGKRRRI E | Lamin B2 | Nucleus | 419 |
| KRKx{9}KIR | HSF2 (human) | Nucleus | 420 |
| KRK VSSSKPEENK IR | HSF2 (human) motif | Nucleus | 622 |
| KRKRx{9}KK | HSF2 (human) | Nucleus | 421 |
| KRKRPL LLNTNGAQKK | HSF2 (human) motif | Nucleus | 623 |
| RLRKx{10}R KFKK | Progesterone receptor (human) | Nucleus | 422 |
| RKDRRGGRML KHKRQRDDGE GRGEVGSAGD MRAANLWPSP LMIKRSKK | Estrogen receptor (human) | Nucleus | 423 |
| KRx{11}KRS R | hnRNP K | Nucleus | 424 |
| KRPAEDMEEE QAFKRSR | hnRNP K motif | Nucleus | 624 |
| RQKRx{13}K RRSSPSKDGR | FHF-1 | Nucleus | 425 |
| RQKRQARESN SDRVSASKRR SSPSKDGR | FHF-1 motif | Nucleus | 625 |

TABLE 6-1-continued

| Exemplary Nuclear Localization Sequences | | | |
|---|---|---|---|
| Signal | Reported Protein(s) | Localization | SEQ ID NO |
| KRx{11}KKT R | NO38 | Nucleus | 426 |
| KRKx{8}KKA KV | xnf7 | Nucleus | 427 |
| KRKLEE PEPEPKKAKV | xnf7 motif | Nucleus | 626 |
| RKKRKx{12}KKSK | N1/N2 | Nucleus | 428 |
| KKx{10}RKR GRPRK | SWI5 | Nucleus | 429 |
| KKx{11}RLR KK | TGA-1A | Nucleus | 430 |
| KKRARx{11}RQRKK | TGA-1B | Nucleus | 431 |
| KLRx{12}RR EIQKR | VirE2 | Nucleus | 432 |
| RAIKTKx{7}KLKSK | VirE2 | Nucleus | 433 |
| RKx{10}RKL KK | Androgen receptor | Nucleus | 434 |
| GKRQVLIRP | S22 | Nucleus | 435 |
| GIIKPISKH | S25 | Nucleus | 436 |
| KKRK | CUL4B | Nucleus | 437 |
| KKLKK | Smad3 | Nucleus | 438 |
| DNPGKKRKST DDNEGPSPKR RVIT | DNA polymerase (AcMNPV) | Nucleus | 439 |
| CSVKRKRDDD | DNA polymerase (AcMNPV) | Nucleus | 440 |
| SKPFSCGRSG KGHKRKTPFG NTERKTPVKK L | MSL1 | Nucleus | 441 |
| KRELELLKHN PKRRKIT | USP22 | Nucleus | 442 |
| RRRK | Calpain 5 | Nucleus | 443 |
| YIFEVKKPED EVLICIQQRP KRSTRREG | Calpain 5 | Nucleus | 444 |
| MADAFEVHYI ADWADISSEY PKLHILTTSG RVLSVLAELS | Muscovy duck reovirus p10.8 | Nucleus | 445 |
| MMPSSVSWGI LLAGLCCLVP VSLA | α-1-antitrypsin | Nucleus | 446 |
| MAGPATQSPM KLMALQLLLW HSALWTVQEA | G-CSF | Nucleus | 447 |
| MQRVNMIMAE SPSLITICLLGY LLSAECTVFLD HENANKILNRP KR | Factor IX | Nucleus | 448 |
| MKGSLLLLLV SNLLLCQSVAP | Prolactin | Nucleus | 449 |
| MKWVTFISLLF LFSSAYSRG VFRR | Albumin | Nucleus | 450 |
| MWWRLWWLL LLLLLLPMWA | HMMSP38 | Nucleus | 451 |
| MLFNLRILLNN AAFRNGHNFM VRNFRCGQPLQ | ornithine carbamoyl-transferase | Nucleus | 452 |

TABLE 6-1-continued

Exemplary Nuclear Localization Sequences

| Signal | Reported Protein(s) | Localization | SEQ ID NO |
|---|---|---|---|
| MSVLTPLLLRG LTGSARRLPVP RAKIHSL | Cytochrome C Oxidase subunit 8A | Nucleus | 453 |
| MSVLTPLLLRG LTGSARRLPVP RAKIHSL | Cytochrome C Oxidase subunit 8A | Nucleus | 454 |
| MVTKITLSPQN FRIQKQETTLL KEKSTEKNSLA KSILAVKNHFI ELRSKLSERFIS HKNT | Type III, bacterial | Nucleus | 455 |
| MLSFVDTRTLL LLAVTSCLATCQ | Viral source | Nucleus | 456 |
| MGSSQAPRMG SVGGHGLMAL LMAGLILPGILA | Viral source | Nucleus | 457 |
| MAGIFYFLFSF LFGICD | Viral source | Nucleus | 458 |
| MENRLLRVFL VWAALTMDG ASA | Viral source | Nucleus | 459 |
| MARQGCFGSY QVISLFTFAIGV NLCLG | Viral source | Nucleus | 460 |
| MSRLPVLLLLQ LLVRPGLQ | *Bacillus* source | Nucleus | 461 |
| MKQQKRLYAR LLTLLFALIFLL PHSSASA | *Bacillus* source | Nucleus | 462 |
| MATPLPPPSPR HLRLLRLLLSG | Secretion signal | Nucleus | 463 |
| MKAPGRLVLII LCSVVFS | Secretion signal | Nucleus | 464 |
| MLQLWKLLCG VLT | Secretion signal | Nucleus | 465 |
| MLYLQGWSM PAVA | Secretion signal | Nucleus | 466 |
| MDNVQPKIKH RPFCFSVKGHV KMLRLDIINSL VTTVFMLIVSV LALIP | Secretion signal | Nucleus | 467 |
| MPCLDQQLTV HALPCPAQPSS LAFCQVGFLTA | Secretion signal | Nucleus | 468 |
| MKTLFNPAPAI ADLDPQFYTLS DVFCCNESEAE ILTGLTVGSAADA | Secretion signal | Nucleus | 469 |
| MKPLLVVFVF LFLWDPVLA | Secretion signal | Nucleus | 470 |
| MSCSLKFTLIVI FFTCTLSSS | Secretion signal | Nucleus | 471 |
| MVLTKPLQRN GSMMSFENVK EKSREGGPHA | Secretion signal | Nucleus | 472 |

TABLE 6-1-continued

| Exemplary Nuclear Localization Sequences | | | |
|---|---|---|---|
| Signal | Reported Protein(s) | Localization | SEQ ID NO |
| HTPEEELCFVV THTPQVQTTL NLFFHIFKVLT QPLSLLWG | | | |
| MATPPFRLIRK MFSFKVSRWM GLACFRSLAAS | Secretion signal | Nucleus | 473 |
| MSFFQLLMKR KELIPLVVFMT VAAGGASS | Secretion signal | Nucleus | 474 |
| MVSALRGAPLI RVHSSPVSSPS VSGPAALVSCL SSQSSALS | Secretion signal | Nucleus | 475 |
| MMGSPVSHLL AGFCVWVVLG | Secretion signal | Nucleus | 476 |
| MASMAAVLT WALALLSAFS ATQA | Secretion signal | Nucleus | 477 |
| MVLMWTSGD AFKTAYFLLK GAPLQFSVCGL LQVLVDLAILG QATA | Secretion signal | Nucleus | 478 |
| MDFVAGAIGG VCGVAVGYPL DTVKVRIQTEP LYTGIWHCVR DTYHRERVWG FYRGLSLPVCT VSLVSS | Secretion signal | Nucleus | 479 |
| MEKPLFPLVPL HWFGFGYTAL VVSGGIVGYV KTGSVPSLAA GLLFGSLA | Secretion signal | Nucleus | 480 |
| MGLLLPLALCI LVLC | Secretion signal | Nucleus | 481 |
| MGIQTSPVLLA SLGVGLVTLL GLAVG | Secretion signal | Nucleus | 482 |
| MSDLLLLGLIG GLTLLLLLTLL AFA | Secretion signal | Nucleus | 483 |
| METVVIVAIGV LATIFLASFAA LVLVCRQ | Secretion signal | Nucleus | 484 |
| MAGSVECTWG WGHCAPSPLL LWTLLLFAAPF GLLG | Secretion signal | Nucleus | 485 |
| MMPSRTNLAT GIPSSKVKYSR LSSTDDGYIDL QFKKTPPKIPY KAIALATVLFLIGA | Secretion signal | Nucleus | 486 |
| MALPQMCDGS HLASTLRYCM TVSGTVVLVA GTLCFA | Secretion signal | Nucleus | 487 |

TABLE 6-1-continued

| Exemplary Nuclear Localization Sequences | | | |
|---|---|---|---|
| Signal | Reported Protein(s) | Localization | SEQ ID NO |
| MKKWFVAAGI GAGLLMLSSAA | Vrg-6 | Nucleus | 488 |
| MKQSTIALALL PLLFTPVTKA | PhoA | Nucleus | 489 |
| MKKTAIAIAV ALAGFATVAQA | OmpA | Nucleus | 490 |
| MKKLMLAIFFS VLSFPSFSQS | STI | Nucleus | 491 |
| MKKNIAFLLAS MFVFSIATNAYA | STII | Nucleus | 492 |
| MFAKRFKTSL LPLFAGFLLLF HLVLAGPAAAS | Amylase | Nucleus | 493 |
| MRFPSIFTAVL FAASSALA | Alpha Factor | Nucleus | 494 |
| MRFPSIFTTVL FAASSALA | Alpha Factor | Nucleus | 495 |
| MRFPSIFTSVLF AASSALA | Alpha Factor | Nucleus | 496 |
| MRFPSIFTHVL FAASSALA | Alpha Factor | Nucleus | 497 |
| MRFPSIFTIVLF AASSALA | Alpha Factor | Nucleus | 498 |
| MRFPSIFTFVLF AASSALA | Alpha Factor | Nucleus | 499 |
| MRFPSIFTEVL FAASSALA | Alpha Factor | Nucleus | 500 |
| MRFPSIFTGVL FAASSALA | Alpha Factor | Nucleus | 501 |
| MRSSPLLRSAV VAALPVLALA | Endoglucanase V | Nucleus | 502 |
| MGAAAVRWH LCVLLALGTR GRL | Secretion Signal | Nucleus | 503 |
| MRSSLVLFFVS AWTALA | Fungal source | Nucleus | 504 |
| MLRGPGPGRL LLLAVLCLGTS VRCTETGKSKR | Fibronectin | Nucleus | 505 |
| MLRGPGPGLL LLAVQCLGTA VPSTGA | Fibronectin | Nucleus | 506 |
| MRRGALTGLL LVLCLSVVLR AAPSATSKKRR | Fibronectin | Nucleus | 507 |

In some embodiments the nuclear protein payload agent localizes a target protein or target nucleic acid to the nucleus. In some embodiments the nuclear protein payload agent is composed of protein containing a nuclear localization sequence and a target binding domain. In some embodiments the target binding domain is an antibody, a nanobody, an scFv, or any other protein binding domain. In some embodiments the target binding domain is a nucleic acid binding domain. In some embodiments the nuclear protein payload agent increases localization in the nucleus of the target protein or target nucleic acid over a cell that does not have the nuclear protein payload agent.

In some embodiments a mitochondrial or peroxisome localization sequence is selected from Table 6-2. In some embodiments a nuclear localization sequence comprises a sequence selected from Table 6-2. In some embodiments a mitochondrial or peroxisome localization sequence of Table 6-2 may be appended to the N-terminus of a protein, e.g., a mitochondrial or peroxisome protein. In some embodiments a signal sequence of Table 6-2 may be appended to the C-terminus of a protein, e.g., a mitochondrial or peroxisome protein. A person of ordinary skill will appreciate that the signal sequences below are not limited for use with their respective naturally associated proteins.

TABLE 6-2

Exemplary mitochondrial or peroxisomal localization sequences

| Signal Sequence | Naturally Associated Protein | Location Associated Protein is Directed | SEQ ID NO |
|---|---|---|---|
| GRV | PaxG | Peroxisomes | 508 |
| SKV | CSS1 and Gibberellin regulated family protein | Peroxisomes | 509 |
| SLM | EDA8/MEE46 and Aspartyl protease family protein | Peroxisomes | 510 |
| SKL | Cit1p/MLYCD | Peroxisomes | 511 |
| SKI | Hydoxyacid oxidase 1/ catalase (*H. polymorpha*) | Peroxisomes | 512 |
| HRM | IPP isomerase(rat) | Peroxisomes | 513 |
| SRL | PMvK/PEPCK/Urate oxidase | Peroxisomes | 514 |
| CKL | HMG-CoA | Peroxisomes | 515 |
| NKL | DAS | Peroxisomes | 516 |
| ARF | MOX | Peroxisomes | 517 |
| AKL | SCPx/pre-nsLTP | Peroxisomes | 518 |
| SQL | AGT (Alanine--glyoxylate aminotransferase) | Peroxisomes | 519 |
| QKL | AA-CoA thiolase | Peroxisomes | 520 |
| ANL | Rat liver catalase | Peroxisomes | 521 |
| AKI | HDE | Peroxisomes | 522 |
| SSL | gPGK | Peroxisomes | 523 |
| Kx{6}[IL]x {1}[LFI]LK [LFI] | PEX2 | Peroxisomes | 524 |
| KVFFSRLIQI LKIMVPRTFC | PMP70 | Peroxisomes | 525 |
| MTVPYLNSNR NVASYLQSNS | Cit2p | Peroxisomes | 526 |
| SVx{5}QL | HMG-CoA synthase/ MPPD | Peroxisomes | 527 |
| MNGDQNSDVY AQEKQDFVQH | FPP | Peroxisomes | 528 |
| MHRLQVVLGH LAGRPESSSA LQAAPC | 3-ketoacyl-CoA thiolase B | Peroxisomes | 529 |
| EALREALQHC PKNKL | SPT | Peroxisomes | 530 |
| LSSNSKF | Catalase A | Peroxisomes | 531 |
| GFATKFYTEE GNLDWVYNNT PVFFI | Catalase A | Peroxisomes | 532 |
| MERLRQIASQ ATAASA | amine oxidase | Peroxisomes | 533 |

TABLE 6-2-continued

Exemplary mitochondrial or peroxisomal localization sequences

| Signal Sequence | Naturally Associated Protein | Location Associated Protein is Directed | SEQ ID NO |
|---|---|---|---|
| KANL | human catalase | Peroxisomes | 534 |
| RPSI | cottonseed catalase (Ccat) | Peroxisomes | 535 |
| APKI | PpPox1p | Peroxisomes | 536 |
| MDLLPPKPKY NPLRNESLSS LEEGASGSTP PE | p46Shc/p66Shc | Mitochondria | 537 |
| MSFFNISRRF YSQIVKKSVK IKR | GlyRS | Mitochondria | 538 |
| MFAAVARRTA TGTLPGAVTL FGRKSFEGYY RDYPLHPRNF GVMASLF | TgSOD2 | Mitochondria | 539 |
| LVPRYRGLFH HISKLDGGVR FL | MLYCD | Mitochondria | 540 |
| MIFPVARYAL RWLRRPEDRA FSRAAMEMAL RGVR | Top3alpha | Mitochondria | 541 |
| MAGRLLGKAL AAVSLSLALA SVTIRSSRCR GIQAFRNSFS SSWFHL | NUDT9 | Mitochondria | 542 |
| PNNSGFIYQQ HGGQQKRARF DHQ | HCF | Mitochondria | 543 |
| MKSFITRNKT AI | 70 kD mitochondrial outer membrane protein | Mitochondria | 544 |
| MFRMLAKASV TLGSRAASWV RNM | SPTm/glyoxylate aminotransferase 1(AGT) | Mitochondria | 545 |
| MFSNLSKRWA QRTLSKSFYS TATGAASKSG KLTQKLVTAG VAAAGITAST LLYADSLTAE A | cytochrome c1 | Mitochondria | 546 |
| MLSSSFERN | SCS-beta | Mitochondria\ Hydrogenosome | 547 |
| MAFWGWRAAA ALRLWGRVVE RVEAGGGVGP FQACGCRLVL GGRDDVSAGL RGSHGARGEP LDP | SIRT3 | Mitochondria | 548 |
| MRRMPRCGIR LPLLRPS | PARG | Mitochondria | 549 |
| MVDRGLGRHL WRLTRRGPPA AADAVAPRPL MGFYEAATQN QADCQLWALL RRGLTTASTL R | UL12 (herpes virus) or UL12.5 | Mitochondria | 550 |
| MAFLRSMWGV LSALGRSGAE LCTGCGSRLR SPFSFVYLPR WF | TFAM | Mitochondria | 551 |

TABLE 6-2-continued

| Exemplary mitochondrial or peroxisomal localization sequences | | | |
|---|---|---|---|
| Signal Sequence | Naturally Associated Protein | Location Associated Protein is Directed | SEQ ID NO |
| HSLLPALCDS KIRSKALGSD HCPITLYLAL | APE1 | Mitochondria | 552 |
| AIRILVCEGS GLLAAANDIL AARAQRPAAR GSTSGGESRL RGERARP | VP22 | Mitochondria | 553 |
| RGFWANLMQI LRDITGVTAI CSFLYTKLGI APFGDPVTMF | GGNNV | Mitochondria | 554 |
| MRTVFSQIPR FKQVNQYIRM | Cdc17 | Mitochondria | 555 |
| MAAACRSVKG L | human 17bHSD10/ SCHAD | Mitochondria | 556 |
| MISASRAAAA RLVGTAASRS PAAARPQDGW NGLSHEAFRF VSRRDY | PBP74 | Mitochondria | 557 |
| RHFWADSKSS | Omb (Outer mitochondrial membrane cytochrome b5) | Mitochondria | 558 |
| MTVPYLNSNR NVASYLQSNS | Cit2p | Mitochondria | 559 |
| MYRYLAKALL PSRAGPAALG SAANHSAALL GRGRGQPAAA SQPGLALAAR RHY | hGDH | Mitochondria | 560 |
| MFIRNFVNII GSQKSITKTI ARNYFSDNSK LIIPRHG | PfHslV | Mitochondria | 561 |
| MLRFTNCSCK TFVKSSYKLN IRRMNSSFRT ETDAFGEIHV PADKYWGAQT QRSFQNFKIG GARERMPLPL VHAFGVLKKS AAIVNESLGG LD | fumarase | Mitochondria | 562 |
| RHSTRTQHLS VETSY | BCS1 | Mitochondria | 563 |
| VVRVTRTWVP KGL | CYP1A1 | Mitochondria | 564 |
| MLATRALSLI GKRAISTSVC LRAHGSVVKS | CYP2E1 | Mitochondria | 565 |
| VRGHPKSRGN FPP | cytochrome P4502B1 | Mitochondria | 566 |
| MLARGLPLRS ALVKACPPIL STVGEGWGHH RVGTGEGAG | CYP11A1 | Mitochondria | 567 |
| FSRSFSTPLP LSTKTLISLS PPHRTFAVRA | GR | Mitochondria | 568 |

TABLE 6-2-continued

Exemplary mitochondrial or peroxisomal localization sequences

| Signal Sequence | Naturally Associated Protein | Location Associated Protein is Directed | SEQ ID NO |
|---|---|---|---|
| TRTWVPKGLK SPP | P450MT2 | Mitochondria | 569 |
| VTHGYNVQRY NQLRKNFGFY RAYSSLRGCK SVFRRI | Hmi1p | Mitochondria | 570 |
| MEFIYIYMNF FFFFSVGRKF KKFNKVRVVR | PR-M (Progesterone Receptor) | Mitochondria | 571 |
| MVGRNSAIAA GVCGALFIGY CIYFDRKRRS DPNFK | Tom 20 | Mitochondria | 572 |
| LLRLIGLTTI FSATALGFLA HKRGLLVRV | monoamine oxidase B | Mitochondria | 573 |
| MALLRGVFIV AAKRTP | 3-oxoacyl-CoA thiolase | Mitochondria | 574 |
| MSTPSIVIAS ARTA | bacterial thiolase | Mitochondria | 575 |
| KTLLSLALVG ACITLGAYLG HK | Bcl-2 | Mitochondria | 576 |
| MKSFITRNKT AILATVAATG TAIGAYYYY | Tom 70/Mas70p | Mitochondria | 577 |
| MLSLRQSIRF FK | cytochrome c oxidase subunit IV | Mitochondria | 578 |
| MGRTVVVLGG GISGLAASYH LSRAPCPP | PPOX | Mitochondria | 579 |
| MLKYKPLLKI SKNCEAAILR ASKTRLNTIR AYGSTVPKSK SFEQDSRKRT QSWTALRVGA ILAATSSVAY LNWHNGQIDN | cytochrome b2 | Mitochondria | 580 |
| CLRRSWNSVT YFQNIGRISL | KMO | Mitochondria | 581 |
| MVLPRLYTAT SRAAFKAAKQ SAPLLST | F1-ATPase beta-subunit | Mitochondria | 582 |
| MQRSIFARF synthase | delta-aminolevulinate | Mitochondria | 583 |
| MLSNLRILLN KAALRKAHTS MVRNFRYGKP VQ | OTC | Mitochondria | 584 |
| MATSASSHLS KAIKHMYMKL PQG | GS | Mitochondria | 585 |
| VAVHNFLNEG AWNEIVEWER RFGKGLM | CCHL | Mitochondria | 586 |
| PKDMTPKAAL LQVLGRINSK YATEPPFDRH DWYV | CCHL | Mitochondria | 587 |

TABLE 6-2-continued

Exemplary mitochondrial or peroxisomal localization sequences

| Signal Sequence | Naturally Associated Protein | Location Associated Protein is Directed | SEQ ID NO |
|---|---|---|---|
| ESRKGQERFN RWFLTGMTVA GVVLLGSLFS RK | Bcl-x(L) | Mitochondria | 588 |
| MANLMMRLPI SLRSFSVSASSS | AtSrx Chloroplast | Mitochondria\ | 589 |
| MWRCGGRQGL GVLRR | MP1 | Mitochondria | 590 |
| MAVFRSGLLV LTTPLASLAP RLASILTSAA | CoAsy | Mitochondria | 591 |
| RALAHGVRVL | HCV | Mitochondria | 592 |
| MRSYEFHLAR MSGATLCVVT GYRLLTSKWL ADRIEDYRQR VI | Protein A (AHNV) | Mitochondria | 593 |
| RPTGFWENLK RILRDITGIT ALCGFLYNKL GMAPFG | Protein A (AHNV) | Mitochondria | 594 |
| TELLVGIATV SGCGAVVYCI SK | Protein A (FHV) | Mitochondria | 595 |
| RYSLKVLLSY HGWMFAEHGK MSRST | CPT1 | Mitochondria | 596 |
| MSVLTPLLL RGLTGSARR LPVPRAKIHSL | Cytochrome C Oxidase subunit 8A | Mitochondria | 597 |

Membrane Protein Payload Agents

In some embodiments a membrane protein payload agent is a protein (or a nucleic acid that encodes it) that is naturally found on a membrane surface of a cell (e.g., on a surface of a plasma membrane).

Exemplary membrane proteins (and/or nucleic acids encoding them) can be found, for example, in U.S. Patent Publication No. 2016/0289674, the contents of which are hereby incorporated by reference. In some embodiments, a membrane protein payload agent (and/or a nucleic acid that encodes it) has a sequence as set forth in any one of SEQ ID NOs: 8144-16131 of U.S. Patent Publication No. 2016/0289674, or in a functional fragment thereof. In some embodiments, a membrane protein payload agent is a plasma membrane protein (nucleic acid encoding it) as set forth in any one of SEQ ID NOs: 8144-16131 of U.S. Patent Publication No. 2016/0289674, or a fragment, variant, or homolog thereof (or nucleic acid that encodes it) of a plasma membrane protein of.

In some embodiments, a membrane protein relevant to the present disclosure is a therapeutic membrane protein. In some embodiments, a membrane protein relevant to the present disclosure is or comprises a cell surface receptor, a membrane transport protein (e.g., an active or passive transport protein such as, for example, an ion channel protein, a pore-forming protein [e.g., a toxin protein], etc), a membrane enzyme, and/or a cell adhesion protein).

In some embodiments a membrane protein is a single spanning membrane protein. In some embodiments a single-spanning membrane protein may assume a final topology with a cytoplasmic N- and an exoplasmic C-terminus ($N_{cyt}/C_{exo}$) or with the opposite orientation ($N_{exo}/C_{cyt}$).

In some embodiments a membrane protein is a Type I membrane protein comprising an N-terminal cleavable signal sequence and stop-transfer sequence ($N_{exo}/C_{cyt}$). In some embodiments a signal is at the C terminus. In some embodiments the N-terminal cleavable signal sequence targets nascent peptide to the ER. In some embodiments an N-terminal cleavable signal sequence comprises a hydrophobic stretch of typically 7-15 predominantly apolar residues. In some embodiments a Type I membrane protein comprises a stop-transfer sequence which halts the further translocation of the polypeptide and acts as a transmembrane anchor. In some embodiments a stop transfer sequence comprises an amino acid sequence of about 20 hydrophobic residues. In some embodiments the N-terminus of the Type I membrane protein is extracellular and the C-terminus is cytoplasmic. In some embodiments a Type I membrane protein may be a glycophorin or an LDL receptor.

In some embodiments a membrane protein is a Type II membrane protein comprising a signal-anchor sequence ($N_{cyt}/C_{exo}$). In some embodiments a signal is at the C terminus. In some embodiments a signal-anchor sequence is responsible for both insertion and anchoring of a Type II membrane protein. In some embodiments a signal-anchor sequence comprises about 18-25 predominantly apolar residues. In some embodiments a signal-anchor sequence lacks a signal peptidase cleavage site. In some embodiments a signal-anchor sequence may be positioned internally within a polypeptide chain. In some embodiments a signal-anchor sequence induces translocation of the C-terminal end of a protein across a cell membrane. In some embodiments the C-terminus of the Type II membrane protein is extracellular and the N-terminus is cytoplasmic. In some embodiments a Type II membrane protein may be a transferrin receptor or a galactosyl transferase receptor.

In some embodiments a membrane protein is a Type III membrane protein comprising a reverse signal-anchor sequence ($N_{exo}/C_{cyt}$). In some embodiments a signal is at the N terminus. In some embodiments a reverse signal-anchor sequence is responsible for both insertion and anchoring of a Type III membrane protein. In some embodiments a reverse signal-anchor sequence comprises about 18-25 predominantly apolar residues. In some embodiments a signal-anchor sequence lacks a signal peptidase cleavage site. In some embodiments a signal-anchor sequence may be positioned internally within a polypeptide chain. In some embodiments a signal-anchor sequence induces translocation of the N-terminal end of a protein across a cell membrane. In some embodiments the N-terminus of the Type III membrane protein is extracellular and the C-terminus is cytoplasmic. In some embodiments a Type I membrane protein may be a synaptogamin, neuregulin, or cytochrome P-450.

In some embodiments, Type I, Type II, or Type III membrane proteins are inserted into a cell membraned via a cellular pathway comprising SRP, SRP receptor and Sec61 translocon.

In some embodiments a membrane protein is predominantly exposed to cytosol and anchored to a membrane by a C-terminal signal sequence, but which does not interact with an SRP. In some embodiments a protein is cytochrome $b_5$, or a SNARE protein (e.g., synaptobrevin).

In some embodiments a membrane protein payload agent comprises a signal sequence which localizes the payload membrane protein to the cell membrane. In some embodiments a membrane protein payload agent is a nucleic acid wherein the nucleic acid encodes a signal sequence which localizes a payload membrane protein encoded by the nucleic acid to the cell membrane.

(i) Integrin Membrane Protein Payloads

In some embodiments, a membrane protein payload agent is or compromises an integrin or functional fragment, variant, or homolog thereof, or a nucleic acid encoding it. In some embodiments a membrane protein payload agent is or compromises an integrin selected from Table 7, or functional fragment, variant, or homolog thereof, or a nucleic acid encoding it. In embodiments, a membrane protein payload agent comprises a protein having a sequence at least least 85%, 86%, 87%, 88%, 89%, 90%, 91%, 92%, 93%, 94%, 95%, 96%, 97%, or 99% identical to the polypeptide sequence of a protein of Table 7, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 7.

TABLE 7

Exemplary integrin proteins

| UniProt ID | Entry name | Gene names |
|---|---|---|
| P05556 | ITB1_HUMAN | ITGB1 FNRB MDF2 MSK12 |
| P05106 | ITB3_HUMAN | ITGB3 GP3A |
| P06756 | ITAV_HUMAN | ITGAV MSK8 VNRA VTNR |
| P05107 | ITB2_HUMAN | ITGB2 CD18 MFI7 |
| P17301 | ITA2_HUMAN | ITGA2 CD49B |
| P23229 | ITA6_HUMAN | ITGA6 |
| P26006 | ITA3_HUMAN | ITGA3 MSK18 |
| P16144 | ITB4_HUMAN | ITGB4 |
| P08514 | ITA2B_HUMAN | ITGA2B GP2B ITGAB |
| P08648 | ITA5_HUMAN | ITGA5 FNRA |
| P13612 | ITA4_HUMAN | ITGA4 CD49D |
| P20701 | ITAL_HUMAN | ITGAL CD11A |
| P11215 | ITAM_HUMAN | ITGAM CD11B CR3A |
| P26010 | ITB7_HUMAN | ITGB7 |
| P20702 | ITAX_HUMAN | ITGAX CD11C |
| P56199 | ITA1_HUMAN | ITGA1 |
| Q9UKX5 | ITA11_HUMAN | ITGA11 MSTP018 |
| P18084 | ITB5_HUMAN | ITGB5 |
| Q13683 | ITA7_HUMAN | ITGA7 UNQ406/PRO768 |
| P53708 | ITA8_HUMAN | ITGA8 |
| P18564 | ITB6_HUMAN | ITGB6 |
| P26012 | ITB8_HUMAN | ITGB8 |
| P38570 | ITAE_HUMAN | ITGAE |
| O75578 | ITA10_HUMAN | ITGA10 UNQ468/PRO827 |
| Q13349 | ITAD_HUMAN | ITGAD |
| Q13797 | ITA9_HUMAN | ITGA9 |

(ii) Ion Channel Proteins

In some embodiments, a membrane protein payload agent is or compromises an ion channel protein or functional fragment, variant, or homolog thereof, or a nucleic acid encoding it. In some embodiments a membrane protein payload agent is or compromises an ion channel protein selected from Table 8, or functional fragment, variant, or homolog thereof, or a nucleic acid encoding it. In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 8, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 8.

TABLE 8

Exemplary ion channel proteins

| Uniprot ID | Entry name | Gene names |
|---|---|---|
| P46098 | 5HT3A_HUMAN | HTR3A 5HT3R HTR3 |
| O95264 | 5HT3B_HUMAN | HTR3B |
| Q8WXA8 | 5HT3C_HUMAN | HTR3C |
| Q70Z44 | 5HT3D_HUMAN | HTR3D |
| A5X5Y0 | 5HT3E_HUMAN | HTR3E |
| P02708 | ACHA_HUMAN | CHRNA1 ACHRA CHNRA |
| P11230 | ACHB_HUMAN | CHRNB1 ACHRB CHRNB |
| Q07001 | ACHD_HUMAN | CHRND ACHRD |
| Q04844 | ACHE_HUMAN | CHRNE ACHRE |
| P07510 | ACHG_HUMAN | CHRNG ACHRG |
| P78348 | ASIC1_HUMAN | ASIC1 ACCN2 BNAC2 |
| Q16515 | ASIC2_HUMAN | ASIC2 ACCN ACCN1 BNAC1 MDEG |
| Q9UHC3 | ASIC3_HUMAN | ASIC3 ACCN3 SLNAC1 TNAC1 |
| Q96FT7 | ASIC4_HUMAN | ASIC4 ACCN4 |
| Q9NY37 | ASIC5_HUMAN | ASIC5 ACCN5 HINAC |
| P37088 | SCNNA_HUMAN | SCNN1A SCNN1 |
| P51168 | SCNNB_HUMAN | SCNN1B |
| P51172 | SCNND_HUMAN | SCNN1D DNACH |
| P51170 | SCNNG_HUMAN | SCNN1G |

TABLE 8-continued

Exemplary ion channel proteins

| Uniprot ID | Entry name | Gene names |
|---|---|---|
| P48048 | KCNJ1_HUMAN | KCNJ1 ROMK1 |
| P78508 | KCJ10_HUMAN | KCNJ10 |
| Q14654 | KCJ11_HUMAN | KCNJ11 |
| Q14500 | KCJ12_HUMAN | KCNJ12 IRK2 KCNJN1 |
| Q9UNX9 | KCJ14_HUMAN | KCNJ14 IRK4 |
| Q99712 | KCJ15_HUMAN | KCNJ15 KCNJ14 |
| Q15842 | KCNJ8_HUMAN | KCNJ8 |
| Q9UGQ2 | FLOWR_HUMAN | CACFD1 C9orf7 PSEC0107 PSEC0248 UNQ3071/PRO9903 |
| Q12791 | KCMA1_HUMAN | KCNMA1 KCNMA SLO |
| Q8NEC5 | CTSR1_HUMAN | CATSPER1 |
| Q96P56 | CTSR2_HUMAN | CATSPER2 |
| Q86XQ3 | CTSR3_HUMAN | CATSPER3 |
| Q7RTX7 | CTSR4_HUMAN | CATSPER4 |
| P29973 | CNGA1_HUMAN | CNGA1 CNCG CNCG1 |
| Q96566 | CLCC1_HUMAN | CLCC1 KIAA0761 MCLC |
| P35523 | CLCN1_HUMAN | CLCN1 CLC1 |
| P51788 | CLCN2_HUMAN | CLCN2 |
| P51800 | CLCKA_HUMAN | CLCNKA |
| P51801 | CLCKB_HUMAN | CLCNKB |
| O00299 | CLIC1_HUMAN | CLIC1 G6 NCC27 |
| O15247 | CLIC2_HUMAN | CLIC2 |
| O95833 | CLIC3_HUMAN | CLIC3 |
| Q9Y696 | CLIC4_HUMAN | CLIC4 |
| Q9NZA1 | CLIC5_HUMAN | CLIC5 |
| Q96NY7 | CLIC6_HUMAN | CLIC6 CLIC1L |
| P51797 | CLCN6_HUMAN | CLCN6 KIAA0046 |
| Q494W8 | CRFM7_HUMAN | CHRFAM7A |
| Q16281 | CNGA3_HUMAN | CNGA3 CNCG3 |
| Q8IV77 | CNGA4_HUMAN | CNGA4 |
| Q14028 | CNGB1_HUMAN | CNGB1 CNCG2 CNCG3L CNCG4 RCNC2 |
| Q9NQW8 | CNGB3_HUMAN | CNGB3 |
| Q16280 | CNGA2_HUMAN | CNGA2 CNCA CNCA1 CNCG2 |
| P48549 | KCNJ3_HUMAN | KCNJ3 GIRK1 |
| P48051 | KCNJ6_HUMAN | KCNJ6 GIRK2 KATP2 KCNJ7 |
| Q92806 | KCNJ9_HUMAN | KCNJ9 GIRK3 |
| P48544 | KCNJ5_HUMAN | KCNJ5 GIRK4 |
| P14867 | GB RA1 HUMAN | GAB RA1 |
| P47869 | GBRA2_HUMAN | GABRA2 |
| P34903 | GBRA3_HUMAN | GABRA3 |
| P48169 | GBRA4_HUMAN | GABRA4 |
| P31644 | GBRA5_HUMAN | GABRA5 |
| Q16445 | GBRA6_HUMAN | GABRA6 |
| P18505 | GBRB1_HUMAN | GABRB1 |
| P47870 | GBRB2_HUMAN | GABRB2 |
| P28472 | GBRB3_HUMAN | GABRB3 |
| O14764 | GBRD_HUMAN | GABRD |
| P78334 | GBRE_HUMAN | GABRE |
| Q8N1C3 | GBRG1_HUMAN | GABRG1 |
| P18507 | GBRG2_HUMAN | GABRG2 |
| Q99928 | GBRG3_HUMAN | GABRG3 |
| O00591 | GBRP_HUMAN | GABRP |
| P24046 | GBRR1_HUMAN | GABRR1 |
| P28476 | GBRR2_HUMAN | GABRR2 |
| A8MPY1 | GBRR3_HUMAN | GABRR3 |
| Q9UN88 | GBRT_HUMAN | GABRQ |
| P42261 | GRIA1_HUMAN | GRIA1 GLUH1 GLUR1 |
| P42262 | GRIA2_HUMAN | GRIA2 GLUR2 |
| P42263 | GRIA3_HUMAN | GRIA3 GLUR3 GLURC |
| P48058 | GRIA4_HUMAN | GRIA4 GLUR4 |
| Q9ULK0 | GRID1_HUMAN | GRID1 KIAA1220 |
| O43424 | GRID2_HUMAN | GRID2 GLURD2 |
| P39086 | GRIK1_HUMAN | GRIK1 GLUR5 |
| Q13002 | GRIK2_HUMAN | GRIK2 GLUR6 |
| Q13003 | GRIK3_HUMAN | GRIK3 GLUR7 |
| Q16099 | GRIK4_HUMAN | GRIK4 GRIK |
| Q16478 | GRIK5_HUMAN | GRIK5 GRIK2 |
| Q05586 | NMDZ1_HUMAN | GRIN1 NMDAR1 |
| Q12879 | NMDE1_HUMAN | GRIN2A NMDAR2A |
| Q13224 | NMDE2_HUMAN | GRIN2B NMDAR2B |
| Q14957 | NMDE3_HUMAN | GRIN2C NMDAR2C |
| O15399 | NMDE4_HUMAN | GRIN2D GluN2D NMDAR2D |
| Q8TCU5 | NMD3A_HUMAN | GRIN3A KIAA1973 |
| O60391 | NMD3B_HUMAN | GRIN3B |
| P23415 | GLRA1_HUMAN | GLRA1 |

TABLE 8-continued

Exemplary ion channel proteins

| Uniprot ID | Entry name | Gene names |
|---|---|---|
| P23416 | GLRA2_HUMAN | GLRA2 |
| O75311 | GLRA3_HUMAN | GLRA3 |
| Q5JXX5 | GLRA4_HUMAN | GLRA4 |
| P48167 | GLRB_HUMAN | GLRB |
| P51790 | CLCN3_HUMAN | CLCN3 |
| P51793 | CLCN4_HUMAN | CLCN4 |
| P51795 | CLCN5_HUMAN | CLCN5 CLCK2 |
| P51798 | CLCN7_HUMAN | CLCN7 |
| O15554 | KCNN4_HUMAN | KCNN4 IK1 IKCA1 KCA4 SK4 |
| O60928 | KCJ13_HUMAN | KCNJ13 |
| Q9NPI9 | KCJ16_HUMAN | KCNJ16 |
| B7U540 | KCJ18_HUMAN | KCNJ18 |
| P63252 | KCNJ2_HUMAN | KCNJ2 IRK1 |
| P48050 | KCNJ4_HUMAN | KCNJ4 IRK3 |
| Q9GZZ6 | ACH10_HUMAN | CHRNA10 NACHRA10 |
| Q15822 | ACHA2_HUMAN | CHRNA2 |
| P32297 | ACHA3_HUMAN | CHRNA3 NACHRA3 |
| P43681 | ACHA4_HUMAN | CHRNA4 NACRA4 |
| P30532 | ACHA5_HUMAN | CHRNA5 NACHRA5 |
| Q15825 | ACHA6_HUMAN | CHRNA6 |
| P36544 | ACHA7_HUMAN | CHRNA7 NACHRA7 |
| Q9UGM1 | ACHA9_HUMAN | CHRNA9 NACHRA9 |
| P17787 | ACHB2_HUMAN | CHRNB2 |
| Q05901 | ACHB3_HUMAN | CHRNB3 |
| P30926 | ACHB4_HUMAN | CHRNB4 |
| O00180 | KCNK1_HUMAN | KCNK1 HOHO1 KCNO1 TWIK1 |
| P57789 | KCNKA_HUMAN | KCNK10 TREK2 |
| Q9HB15 | KCNKC_HUMAN | KCNK12 |
| Q9HB14 | KCNKD_HUMAN | KCNK13 |
| Q9H427 | KCNKF_HUMAN | KCNK15 TASKS |
| Q96T55 | KCNKG_HUMAN | KCNK16 TALK1 |
| Q96T54 | KCNKH_HUMAN | KCNK17 TALK2 TASK4 UNQ5816/PRO19634 |
| Q7Z418 | KCNKI_HUMAN | KCNK18 TRESK TRIK |
| O95069 | KCNK2_HUMAN | KCNK2 TREK TREK1 |
| O14649 | KCNK3_HUMAN | KCNK3 TASK TASK1 |
| Q9NYG8 | KCNK4_HUMAN | KCNK4 TRAAK |
| O95279 | KCNK5_HUMAN | KCNK5 TASK2 |
| Q9Y257 | KCNK6_HUMAN | KCNK6 TOSS TWIK2 |
| Q9Y2U2 | KCNK7_HUMAN | KCNK7 |
| Q9NPC2 | KCNK9_HUMAN | KCNK9 TASK3 |
| Q5JUK3 | KCNT1_HUMAN | KCNT1 KIAA1422 |
| Q6UVM3 | KCNT2_HUMAN | KCNT2 SLICK |
| A8MYU2 | KCNU1_HUMAN | KCNU1 KCNMA3 KCNMC1 SLO3 |
| Q09470 | KCNA1_HUMAN | KCNA1 |
| Q16322 | KCA10_HUMAN | KCNA10 |
| P16389 | KCNA2_HUMAN | KCNA2 |
| P22001 | KCNA3_HUMAN | KCNA3 HGK5 |
| P22459 | KCNA4_HUMAN | KCNA4 KCNA4L |
| P22460 | KCNA5_HUMAN | KCNA5 |
| P17658 | KCNA6_HUMAN | KCNA6 |
| Q96RP8 | KCNA7_HUMAN | KCNA7 |
| Q14721 | KCNB1_HUMAN | KCNB1 |
| Q92953 | KCNB2_HUMAN | KCNB2 |
| P48547 | KCNC1_HUMAN | KCNC1 |
| Q96PR1 | KCNC2_HUMAN | KCNC2 |
| Q14003 | KCNC3_HUMAN | KCNC3 |
| Q03721 | KCNC4_HUMAN | KCNC4 Clorf30 |
| Q9NSA2 | KCND1_HUMAN | KCND1 |
| Q9NZV8 | KCND2_HUMAN | KCND2 KIAA1044 |
| Q9UK17 | KCND3_HUMAN | KCND3 |
| P15382 | KCNE1_HUMAN | KCNE1 |
| A0A087WTH5 | KCE1B_HUMAN | KCNE1B |
| Q9Y6J6 | KCNE2_HUMAN | KCNE2 |
| Q9Y6H6 | KCNE3_HUMAN | KCNE3 |
| Q8WWG9 | KCNE4_HUMAN | KCNE4 |
| Q9UJ90 | KCNE5_HUMAN | KCNE5 AMMECR2 KCNE1L |
| Q9H3M0 | KCNF1_HUMAN | KCNF1 |
| Q9UIX4 | KCNG1_HUMAN | KCNG1 |
| Q9UJ96 | KCNG2_HUMAN | KCNG2 KCNF2 |
| Q8TAE7 | KCNG3_HUMAN | KCNG3 |
| Q8TDN1 | KCNG4_HUMAN | KCNG4 KCNG3 |
| 095259 | KCNH1_HUMAN | KCNH1 EAG EAG1 |
| Q12809 | KCNH2_HUMAN | KCNH2 ERG ERG1 HERG |
| Q9ULD8 | KCNH3_HUMAN | KCNH3 KIAA1282 |

TABLE 8-continued

| Exemplary ion channel proteins | | |
|---|---|---|
| Uniprot ID | Entry name | Gene names |
| Q9UQ05 | KCNH4_HUMAN | KCNH4 |
| Q8NCM2 | KCNH5_HUMAN | KCNH5 EAG2 |
| Q9H252 | KCNH6_HUMAN | KCNH6 ERG2 |
| Q9NS40 | KCNH7_HUMAN | KCNH7 ERG3 |
| Q96L42 | KCNH8_HUMAN | KCNH8 |
| P51787 | KCNQ1_HUMAN | KCNQ1 KCNA8 KCNA9 KVLQT1 |
| 043526 | KCNQ2_HUMAN | KCNQ2 |
| 043525 | KCNQ3_HUMAN | KCNQ3 |
| P56696 | KCNQ4_HUMAN | KCNQ4 |
| Q9NR82 | KCNQ5_HUMAN | KCNQ5 |
| Q96KK3 | KCNS1_HUMAN | KCNS1 |
| Q9ULS 6 | KCNS2_HUMAN | KCNS2 KIAA1144 |
| Q9B Q31 | KCNS3_HUMAN | KCNS3 |
| Q6PIU1 | KCNV1_HUMAN | KCNV1 |
| Q8TDN2 | KCNV2_HUMAN | KCNV2 |
| O60741 | HCN1_HUMAN | HCN1 BCNG1 |
| Q9UL51 | HCN2_HUMAN | HCN2 BCNG2 |
| Q9P1Z3 | HCN3_HUMAN | HCN3 KIAA1535 |
| Q9Y3Q4 | HCN4_HUMAN | HCN4 |
| Q92952 | KCNN1_HUMAN | KCNN1 SK |
| Q9H2S1 | KCNN2_HUMAN | KCNN2 |
| Q9UGI6 | KCNN3_HUMAN | KCNN3 K3 |
| P35498 | SCN1A_HUMAN | SCN1A NAC1 SCN1 |
| Q9Y5Y9 | SCNAA_HUMAN | SCN10A |
| Q9UI33 | SCNBA_HUMAN | SCN11A SCN12A SNS2 |
| Q99250 | SCN2A_HUMAN | SCN2A NAC2 SCN2A1 SCN2A2 |
| Q9NY46 | SCN3A_HUMAN | SCN3A KIAA1356 NAC3 |
| P35499 | SCN4A_HUMAN | SCN4A |
| Q14524 | SCN5A_HUMAN | SCN5A |
| Q01118 | SCN7A_HUMAN | SCN7A SCN6A |
| Q9UQD0 | SCN8A_HUMAN | SCN8A MED |
| Q15858 | SCN9A_HUMAN | SCN9A NENA |
| Q07699 | SCN1B_HUMAN | SCN1B |
| O60939 | SCN2B_HUMAN | SCN2B UNQ326/PRO386 |
| Q9NY72 | SCN3B_HUMAN | SCN3B KIAA1158 |
| Q8IWT1 | SCN4B_HUMAN | SCN4B |
| Q8IZF0 | NALCN_HUMAN | NALCN VGCNL1 |
| Q9ULQ1 | TPC1_HUMAN | TPCN1 KIAA1169 TPC1 |
| Q8NHX9 | TPC2_HUMAN | TPCN2 TPC2 |
| P54289 | CA2D1_HUMAN | CACNA2D1 CACNL2A CCHL2A MHS3 |
| Q9NY47 | CA2D2_HUMAN | CACNA2D2 KIAA0558 |
| Q8IZS8 | CA2D3_HUMAN | CACNA2D3 |
| Q7Z3S7 | CA2D4_HUMAN | CACNA2D4 |
| Q13936 | CAC1C_HUMAN | CACNA1C CACH2 CACN2 CACNL1A1 CCHL1A1 |
| Q01668 | CAC1D_HUMAN | CACNA1D CACH3 CACN4 CACNL1A2 CCHL1A2 |
| O60840 | CAC1F_HUMAN | CACNA1F CACNAF1 |
| Q13698 | CAC1S_HUMAN | CACNA1S CACH1 CACN1 CACNL1A3 |
| Q02641 | CACB1_HUMAN | CACNB1 CACNLB1 |
| Q08289 | CACB2_HUMAN | CACNB2 CACNLB2 MYSB |
| P54284 | CACB3_HUMAN | CACNB3 CACNLB3 |
| O00305 | CACB4_HUMAN | CACNB4 CACNLB4 |
| Q00975 | CAC1B_HUMAN | CACNA1B CACH5 CACNL1A5 |
| O00555 | CAC1A_HUMAN | CACNA1A CACH4 CACN3 CACNL1A4 |
| Q15878 | CAC1E_HUMAN | CACNA1E CACH6 CACNL1A6 |
| O43497 | CAC1G_HUMAN | CACNA1G KIAA1123 |
| O95180 | CAC1H_HUMAN | CACNA1H |
| Q9P0X4 | CAC1I_HUMAN | CACNA1I KIAA1120 |
| Q96D96 | HVCN1_HUMAN | HVCN1 VSOP UNQ578/PRO1140 |
| Q14722 | KCAB1_HUMAN | KCNAB1 KCNA1B |
| Q13303 | KCAB2_HUMAN | KCNAB2 KCNA2B KCNK2 |
| O43448 | KCAB3_HUMAN | KCNAB3 KCNA3B |
| Q5VU97 | CAHD1_HUMAN | CACHD1 KIAA1573 VWCD1 |
| Q401N2 | ZACN_HUMAN | ZACN L2 LGICZ LGICZ1 ZAC |

(iii) Pore Forming Proteins

In some embodiments, a membrane protein payload agent is or compromises a pore forming protein or functional fragment, variant, or homolog thereof, or a nucleic acid encoding it. In some embodiments, a pore forming protein may be a hemolysin or functional fragment, variant, or homolog thereof, or a nucleic acid encoding it. In some embodiments a membrane protein payload agent is or compromises a hemolysin selected from Table 9, or functional fragment, variant, or homolog thereof, or a nucleic acid encoding it. In some embodiments, a pore forming protein may be a colicin or functional fragment, variant, or homolog thereof, or a nucleic acid encoding it. In some embodiments a membrane protein payload agent is or compromises a colicin selected from Table 10, or functional fragment, variant, or homolog thereof, or a nucleic acid encoding it.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 9, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 9.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 10, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 10.

TABLE 9

| Exemplary hemolysin proteins | | |
|---|---|---|
| Uniprot ID | Entry name | Gene names |
| P19247 | VVHA_VIBVU | vvhA VV2_0404 |
| P09545 | HLYA_VIBCH | hlyA VC_A0219 |
| Q08677 | HLY4_AERSA | ash4 |
| P55870 | HLY1_AERHH | ahh1 AHA_1512 |
| Q4UK99 | HLYC_RICFE | tlyC RF_1185 |
| Q68W10 | HLYC_RICTY | tlyC RT0725 |
| O05961 | HLYC_RICPR | tlyC RP740 |
| A8GTI4 | HLYC_RICRS | tlyC A1G_06280 |
| Q92GI2 | HLYC_RICCN | tlyC RC1141 |
| A8F2M1 | HLYC_RICM5 | tlyC RMA_1168 |
| Q93RR6 | HLYE_SALPA | hlyE clyA sheA SPA1306 |
| Q9REB3 | HLYE_ECO57 | hlyE clyA sheA Z1944 ECs1677 |
| Q8Z727 | HLYE_SALTI | hlyE clyA sheA STY1498 t1477 |
| P77335 | HLYE_ECOLI | hlyE clyA hpr sheA ycgD b1182 JW5181 |
| P14711 | HLYT_GRIHO | |
| A8GUH1 | HLYC_RICB8 | tlyC A1I_00305 |
| A8EZUO | HLYC_RICCK | tlyC A1E_04760 |
| A8GPR9 | HLYC_RICAH | tlyC A1C_05795 |
| Q1RGX2 | HLYC_RICBR | tlyC RBE 1311 |
| Q9RCT3 | HLYEL_SHIFL | SF1171 S1259 |
| Q8FI27 | HLYEL_ECOL6 | c1630 |
| P28030 | HLY_VIBMI | tdh |
| P28031 | HLY1_GRIHO | tdh |
| P19249 | HLY1_VIBPA | tdh1 tdh VPA1378 |
| P19250 | HLY2_VIBPA | tdh2 tdh trh VPA1314 |
| P28029 | HLY3_VIBPH | tdh3 tdh/I tdhX |

TABLE 10

| Exemplary colicin proteins | | |
|---|---|---|
| Uniprot ID | Entry name | Gene names |
| Q47500 | CE05_ECOLX | cfa |
| Q47125 | CE10_ECOLX | cta |

TABLE 10-continued

| Exemplary colicin proteins | | |
|---|---|---|
| Uniprot ID | Entry name | Gene names |
| P04480 | CEA_CITFR | caa |
| Q47108 | CEA_ECOLX | caa |
| P02978 | CEA1_ECOLX | cea |
| P21178 | CEA1_SHISO | cea |
| P04419 | CEA2_ECOLX | col ceaB |
| P00646 | CEA3_ECOLX | ceaC |
| P18000 | CEA5_ECOLX | col |
| P17999 | CEA6_ECOLX | |
| Q47112 | CEA7_ECOLX | colE7 cea |
| P09882 | CEA8_ECOLX | col |
| P09883 | CEA9_ECOLX | col cei |
| P05819 | CEAB_ECOLX | cba |
| P00645 | CEAC_ECOLX | ccl |
| P17998 | CEAD_ECOLX | cda |
| Q47502 | CEAK_ECOLX | cka |
| P08083 | CEAN_ECOLX | cna |
| P06716 | CEIA_ECOLX | cia |
| P04479 | CEIB_ECOLX | cib |
| P22520 | CVAB_ECOLX | cvaB |
| Q06583 | PYS1_PSEAI | pys1 |
| Q06584 | PYS2_PSEAE | pys2 PA1150 |

(iv) Toll-Like Receptors

In some embodiments, a membrane protein payload agent is or compromises a toll-like receptor (TLR) or functional fragment, variant, or homolog thereof, or a nucleic acid encoding it. In some embodiments a membrane protein payload agent is or compromises a toll-like receptor selected from Table 11, or functional fragment, variant, or homolog thereof, or a nucleic acid encoding it. In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 11, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 11.

TABLE 11

| Exemplary toll-like receptors | | |
|---|---|---|
| UniProt ID | Entry name | Gene names (primary) |
| Q86XR7 | TCAM2_HUMAN | TICAM2 |
| Q9BXR5 | TLR10_HUMAN | TLR10 |
| Q15399 | TLR1_HUMAN | TLR1 |
| O60603 | TLR2_HUMAN | TLR2 |
| O15455 | TLR3_HUMAN | TLR3 |
| O00206 | TLR4_HUMAN | TLR4 |
| O60602 | TLR5_HUMAN | TLR5 |
| Q9Y2C9 | TLR6_HUMAN | TLR6 |
| Q9NYK1 | TLR7_HUMAN | TLR7 |
| Q9NR97 | TLR8_HUMAN | TLR8 |
| Q9NR96 | TLR9_HUMAN | TLR9 |

In some embodiments, a membrane protein payload agent is or compromises an interleukin receptor or functional fragment, variant, or homolog thereof, or a nucleic acid encoding it. In some embodiments a membrane protein payload agent is or compromises an interleukin receptor selected from Table 12 or functional fragment, variant, or homolog thereof, or a nucleic acid encoding it. In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 12, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 12.

(v) Interleukin Receptor Payloads

TABLE 12

| Exemplary interleukin receptors | | |
|---|---|---|
| Uniprot ID | Entry name | Gene names (primary) |
| Q5EG05 | CAR16_HUMAN | CARD16 |
| Q92851 | CASPA_HUMAN | CASP10 |
| P25024 | CXCR1_HUMAN | CXCR1 |
| P25025 | CXCR2_HUMAN | CXCR2 |
| P31785 | IL2RG_HUMAN | IL2RG |
| Q01167 | FOXK2_HUMAN | FOXK2 |
| Q8IU57 | INLR1_HUMAN | IFNLR1 |
| Q8IU54 | IFNL1_HUMAN | IFNL1 |
| Q8IZJ0 | IFNL2_HUMAN | IFNL2 |
| Q8IZI9 | IFNL3_HUMAN | IFNL3 |
| Q12905 | ILF2_HUMAN | ILF2 |
| Q12906 | ILF3_HUMAN | ILF3 |
| P01583 | IL1A_HUMAN | IL1A |
| P01584 | IL1B_HUMAN | IL1B |
| Q8WWZ1 | IL1FA_HUMAN | IL1F10 |
| Q9NPH3 | IL1AP_HUMAN | IL1RAP |
| Q9NZN1 | IRPL1_HUMAN | IL1RAPL1 |
| P18510 | IL1RA_HUMAN | IL1RN |
| P14778 | IL1R1_HUMAN | IL1R1 |
| P27930 | IL1R2_HUMAN | IL1R2 |
| P51617 | IRAK1_HUMAN | IRAK1 |
| Q5VVH5 | IKBP1_HUMAN | IRAK1BP1 |
| Q9Y616 | IRAK3_HUMAN | IRAK3 |
| Q9NWZ3 | IRAK4_HUMAN | IRAK4 |
| O43187 | IRAK2_HUMAN | IRAK2 |
| Q01638 | ILRL1_HUMAN | IL1RL1 |
| Q9HB29 | ILRL2_HUMAN | IL1RL2 |
| P22301 | IL10_HUMAN | IL10 |
| Q13651 | Il0R1_HUMAN | IL10RA |
| Q08334 | I10R2_HUMAN | IL10RB |
| P20809 | IL11_HUMAN | IL11 |
| Q14626 | I11RA HUMAN | IL11RA |
| P42701 | I12R1_HUMAN | IL12RB1 |
| Q99665 | I12R2_HUMAN | IL12RB2 |
| P29459 | IL12A_HUMAN | IL12A |
| P29460 | IL12B_HUMAN | IL12B |
| P35225 | IL13_HUMAN | IL13 |
| P78552 | I13R1_HUMAN | IL13RA1 |
| Q14627 | I13R2_HUMAN | IL13RA2 |
| P40933 | IL15_HUMAN | IL15 |
| Q13261 | I15RA_HUMAN | IL15RA |
| Q96F46 | I17RA_HUMAN | IL17RA |
| Q9NRM6 | I17RB_HUMAN | IL17RB |
| Q8NAC3 | I17RC_HUMAN | IL17RC |
| Q8NFM7 | I17RD_HUMAN | IL17RD |
| Q8NFR9 | I17RE_HUMAN | IL17RE |
| Q16552 | IL17_HUMAN | IL17A |
| Q9UHF5 | IL17B_HUMAN | IL17B |
| Q9P0M4 | IL17C_HUMAN | IL17C |
| Q8TAD2 | IL17D_HUMAN | IL17D |
| Q96PD4 | IL17F_HUMAN | IL17F |
| Q13478 | IL18R_HUMAN | IL18R1 |
| O95256 | I18RA_HUMAN | IL18RAP |
| O95998 | I18BP_HUMAN | IL18BP |
| P60568 | IL2_HUMAN | IL2 |
| P01589 | IL2RA_HUMAN | IL2RA |
| P14784 | IL2RB_HUMAN | IL2RB |
| Q9NYY1 | IL20_HUMAN | IL20 |
| Q9UHF4 | I20RA_HUMAN | IL20RA |
| Q6UXL0 | I20RB_HUMAN | IL20RB |
| Q9HBE4 | IL21_HUMAN | IL21 |
| Q9HBE5 | IL21R_HUMAN | IL21R |
| Q9GZX6 | IL22_HUMAN | IL22 |
| Q8N6P7 | 122R1_HUMAN | IL22RA1 |
| Q969J5 | I22R2_HUMAN | IL22RA2 |

TABLE 12-continued

| Exemplary interleukin receptors | | |
|---|---|---|
| Uniprot ID | Entry name | Gene names (primary) |
| Q5VWK5 | IL23R_HUMAN | IL23R |
| Q9NPF7 | IL23A_HUMAN | IL23 A |
| Q9H293 | IL25_HUMAN | IL25 |
| Q9NPH9 | IL26_HUMAN | IL26 |
| Q6UWB 1 | I27RA_HUMAN | IL27RA |
| Q8NEV9 | IL27A_HUMAN | IL27 |
| Q14213 | IL27B_HUMAN | EBI3 |
| P08700 | IL3_HUMAN | IL3 |
| P26951 | IL3RA_HUMAN | IL3RA |
| Q6EB C2 | IL31_HUMAN | IL31 |
| Q8NI17 | IL31R_HUMAN | IL31RA |
| O95760 | IL33_HUMAN | IL33 |
| Q6ZMJ4 | IL34_HUMAN | IL34 |
| Q9UHA7 | IL36A_HUMAN | IL36A |
| Q9NZH7 | IL36B_HUMAN | IL36B |
| Q9NZH8 | IL36G_HUMAN | IL36G |
| Q9UBH0 | I36RA_HUMAN | IL36RN |
| Q9NZH6 | IL37_HUMAN | IL37 |
| P05112 | IL4_HUMAN | IL4 |
| P24394 | IL4RA_HUMAN | IL4R |
| P05113 | IL5_HUMAN | IL5 |
| Q01344 | IL5RA_HUMAN | IL5RA |
| P05231 | IL6_HUMAN | IL6 |
| P08887 | IL6RA_HUMAN | IL6R |
| P40189 | IL6RB_HUMAN | IL6ST |
| P13232 | IL7_HUMAN | IL7 |
| P16871 | IL7RA_HUMAN | IL7R |
| P10145 | IL8_HUMAN | CXCL8 |
| P15248 | IL9_HUMAN | IL9 |
| Q01113 | IL9R_HUMAN | IL9R |
| Q16649 | NFIL3_HUMAN | NFIL3 |
| Q99650 | OSMR_HUMAN | OSMR |
| Q8NDX1 | PSD4_HUMAN | PSD4 |
| Q14005 | IL16_HUMAN | IL16 |
| Q6ZVW7 | I17EL_HUMAN | IL17REL |
| O43353 | RIPK2_HUMAN | RIPK2 |
| Q6IA 17 | SIGIR_HUMAN | SIGIRR |
| Q8IUC 6 | TCAM1_HUMAN | TICAM1 |
| Q86XR7 | TCAM2_HUMAN | TICAM2 |
| Q9Y4K3 | TRAF6_HUMAN | TRAF6 |
| P58753 | TIRAP_HUMAN | TIRAP |
| Q15399 | TLR1_HUMAN | TLR1 |
| O60603 | TLR2_HUMAN | TLR2 |
| O60602 | TLR5_HUMAN | TLR5 |
| Q8TDR0 | MIPT3_HUMAN | TRAF3IP1 |
| Q13445 | TMED1_HUMAN | TMED1 |
| Q08881 | ITK_HUMAN | ITK |
| Q9NP60 | IRPL2_HUMAN | IL1RAPL2 |

(vi) Cell Adhesion Protein Payloads

In some embodiments, a membrane protein payload agent is or compromises a cell adhesion protein or functional fragment, variant, or homolog thereof, or a nucleic acid encoding it. In some embodiments a membrane protein payload agent is or compromises a cell adhesion protein selected from Table 13, or functional fragment, variant, or homolog thereof, or a nucleic acid encoding it. In some embodiments, a cell adhesion protein may be a cadherin or functional fragment, variant, or homolog thereof, or a nucleic acid encoding it. In some embodiments a membrane protein payload agent is or compromises a cadherin selected from Table 14, or functional fragment, variant, or homolog thereof, or a nucleic acid encoding it. In some embodiments, a cell adhesion protein may be a selectin or functional fragment, variant, or homolog thereof, or a nucleic acid encoding it. In some embodiments a membrane protein payload agent is or compromises a selectin selected from Table 15, or functional fragment, variant, or homolog thereof, or a nucleic acid encoding it. In some embodiments, a cell adhesion protein may be a mucin or functional fragment, variant, or homolog thereof, or a nucleic acid encoding it. In some embodiments a membrane protein payload agent is or compromises a mucin selected from Table 16, or functional fragment, variant, or homolog thereof, or a nucleic acid encoding it.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 13, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 13.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 14, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 14.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 15, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 15.

In embodiments, a membrane protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 16, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 16.

TABLE 13

| Exemplary intercellular adhesion molecule proteins | | |
|---|---|---|
| UniProt ID | Entry name | Gene names (primary) |
| P05362 | ICAM1_HUMAN | ICAM1 |
| P13598 | ICAM2_HUMAN | ICAM2 |
| P32942 | ICAM3_HUMAN | ICAM3 |
| Q14773 | ICAM4_HUMAN | ICAM4 |
| Q9UMF0 | ICAM5_HUMAN | ICAM5 |

TABLE 14

| Exemplary cadherin proteins | | |
|---|---|---|
| Uniprot ID | Entry name | Gene names (primary) |
| P07949 | RET_HUMAN | RET |
| P12830 | CADH1_HUMAN | CDH1 |
| P55290 | CAD13_HUMAN | CDH13 |
| Q9H251 | CAD23_HUMAN | CDH23 |

TABLE 14-continued

Exemplary cadherin proteins

| Uniprot ID | Entry name | Gene names (primary) |
|---|---|---|
| P19022 | CADH2_HUMAN | CDH2 |
| O60716 | CTND1_HUMAN | CTNND1 |
| P35221 | CTNA1_HUMAN | CTNNA1 |
| P22223 | CADH3_HUMAN | CDH3 |
| P33151 | CADH5_HUMAN | CDH5 |
| Q9NYQ6 | CELR1_HUMAN | CELSR1 |
| Q14126 | DSG2_HUMAN | DSG2 |
| Q9HBB8 | CDHR5_HUMAN | CDHR5 |
| Q96JQ0 | PCD16_HUMAN | DCHS1 |
| O94985 | CSTN1_HUMAN | CLSTN1 |
| Q02487 | DSC2_HUMAN | DSC2 |
| Q6V0I7 | FAT4_HUMAN | FAT4 |
| Q02413 | DSG1_HUMAN | DSG1 |
| Q14517 | FAT1_HUMAN | FAT1 |
| Q9BYE9 | CDHR2_HUMAN | CDHR2 |
| P55291 | CAD15_HUMAN | CDH15 |
| A7KAX9 | RHG32_HUMAN | ARHGAP32 |
| Q12864 | CAD17_HUMAN | CDH17 |
| P55287 | CAD11_HUMAN | CDH11 |
| Q9NYQ7 | CELR3_HUMAN | CELSR3 |
| Q14574 | DSC3_HUMAN | DSC3 |
| Q9NYQ8 | FAT2_HUMAN | FAT2 |
| P55283 | CADH4_HUMAN | CDH4 |
| P55285 | CADH6_HUMAN | CDH6 |
| P55286 | CADH8_HUMAN | CDH8 |
| Q9Y6N8 | CAD10_HUMAN | CDH10 |
| P55289 | CAD12_HUMAN | CDH12 |
| Q13634 | CAD18_HUMAN | CDH18 |
| Q9UJ99 | CAD22_HUMAN | CDH22 |
| O75309 | CAD16_HUMAN | CDH16 |
| Q9H159 | CAD19_HUMAN | CDH19 |
| Q9HBT6 | CAD20_HUMAN | CDH20 |
| Q8IXH8 | CAD26_HUMAN | CDH26 |
| Q9ULB5 | CADH7_HUMAN | CDH7 |
| Q9ULB4 | CADH9_HUMAN | CDH9 |
| Q6ZTQ4 | CDHR3_HUMAN | CDHR3 |
| Q9HCU4 | CELR2_HUMAN | CELSR2 |
| Q86UP0 | CAD24_HUMAN | CDH24 |
| Q96JP9 | CDHR1_HUMAN | CDHR1 |
| A6H8M9 | CDHR4_HUMAN | CDHR4 |
| Q9UI47 | CTNA3_HUMAN | CTNNA3 |
| A4D0V7 | CPED1_HUMAN | CPED1 |
| Q08554 | DSC 1_HUMAN | DSC1 |
| P32926 | DS G3_HUMAN | DSG3 |
| Q86SJ6 | DS G4_HUMAN | DSG4 |
| Q8TDW7 | FAT3_HUMAN | FAT3 |
| Q9NPG4 | PCD12_HUMAN | PCDH12 |
| O60330 | PCDGC_HUMAN | PCDHGA12 |
| Q6V1P9 | PCD23_HUMAN | DCHS2 |
| Q9UN71 | PCDGG_HUMAN | PCDHGB4 |
| Q08174 | PCDH1_HUMAN | PCDH1 |

TABLE 15

Exemplary selectin proteins

| UniProt ID | Entry name | Gene names (primary) |
|---|---|---|
| P16109 | LYAM3 HUMAN | SELP |
| P16581 | LYAM2 HUMAN | SELE |
| Q14242 | SELPL HUMAN | SELPLG |
| P14151 | LYAM1 HUMAN | SELL |

TABLE 16

Exemplary mucin proteins

| UniProt ID | Entry name | Gene names (primary) |
|---|---|---|
| P15941 | MUC1_HUMAN | MUC1 |
| Q99102 | MUC4_HUMAN | MUC4 |

TABLE 16-continued

Exemplary mucin proteins

| UniProt ID | Entry name | Gene names (primary) |
|---|---|---|
| Q8TDQ0 | HAVR2_HUMAN | HAVCR2 |
| Q9HC84 | MUC5B_HUMAN | MUC5B |
| P98088 | MUC5A_HUMAN | MUC5AC |
| Q685J3 | MUC17_HUMAN | MUC17 |
| Q9UJU6 | DB NL_HUMAN | DBNL |
| Q9HBB8 | CDHR5_HUMAN | CDHR5 |
| Q8WXI7 | MUC16_HUMAN | MUC16 |
| Q9UHX3 | AGRE2_HUMAN | ADGRE2 |
| Q02817 | MUC2_HUMAN | MUC2 |
| Q8TAX7 | MUC7_HUMAN | MUC7 |
| Q96D42 | HAVR1_HUMAN | HAVCR1 |
| Q9H3R2 | MUC13_HUMAN | MUC 13 |
| Q8N307 | MUC20_HUMAN | MUC20 |
| Q6W4X9 | MUC6_HUMAN | MUC6 |
| Q02505 | MUC3A_HUMAN | MUC3A |
| Q7L513 | FCRLA_HUMAN | FCRLA |
| Q14246 | AGRE1_HUMAN | ADGRE1 |
| Q86WA6 | BPHL_HUMAN | BPHL |
| Q7Z5P9 | MUC19_HUMAN | MUC19 |
| Q9UKN1 | MUC12_HUMAN | MUC12 |
| Q5SSG8 | MUC21_HUMAN | MUC21 |
| Q9B Y15 | AGRE3_HUMAN | ADGRE3 |
| Q6UWI2 | PARM1_HUMAN | PARM1 |
| O95395 | GCNT3_HUMAN | GCNT3 |
| Q86SQ3 | AGRE4_HUMAN | ADGRE4P |
| Q6BAA4 | FCRLB_HUMAN | FCRLB |
| Q96DR8 | MUCL1_HUMAN | MUCL1 |
| E2RYF6 | MUC22_HUMAN | MUC22 |
| Q9H195 | MUC3B_HUMAN | MUC3B |
| Q9ULC0 | MUCEN_HUMAN | EMCN |
| Q8N387 | MUC15_HUMAN | MUC 15 |
| Q12889 | OVGP1_HUMAN | OVGP1 |
| E2RYF7 | PBMU2_HUMAN | HCG22 |
| Q96H15 | TIMD4_HUMAN | TIMD4 |

(vii) Transport Protein Payloads

In some embodiments, a membrane protein payload agent is or compromises a transport protein or functional fragment, variant, or homolog thereof, or a nucleic acid encoding it. In some embodiments a membrane protein payload agent is or compromises a transport protein selected from Table 17, or functional fragment, variant, or homolog thereof, or a nucleic acid encoding it. In embodiments, a membrane protein payload agent comprises a protein having a sequence at least least 85%, 86%, 87%, 88%, 89%, 90%, 91%, 92%, 93%, 94%, 95%, 96%, 97%, or 99% identical to the polypeptide sequence of a protein of Table 17, or a nucleic acid encoding the same. In embodiments, the membrane protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 17.

TABLE 17

Exemplary transport proteins

| UniProt ID | Entry name | Gene names (primary) |
|---|---|---|
| Q9NRA8 | 4ET_HUMAN | EIF4ENIF1 |
| Q9NS82 | AAA1_HUMAN | SLC7A10 |
| Q15758 | AAAT_HUMAN | SLC1A5 |
| O95477 | ABCA1 HUMAN | ABCA1 |
| Q9BZC7 | ABCA2_HUMAN | ABCA2 |
| Q99758 | ABCA3_HUMAN | ABCA3 |
| P78363 | ABCA4_HUMAN | ABCA4 |
| Q8IZY2 | ABCA7_HUMAN | ABCA7 |
| Q86UK0 | ABCAC_HUMAN | ABCA12 |
| Q9NP58 | ABCB6_HUMAN | ABCB6 |
| O75027 | ABCB7_HUMAN | ABCB7 |

TABLE 17-continued

| Exemplary transport proteins | | |
|---|---|---|
| UniProt ID | Entry name | Gene names (primary) |
| Q9NP78 | ABCB9_HUMAN | ABCB9 |
| Q9NRK6 | ABCBA_HUMAN | ABCB10 |
| Q9UG63 | ABCF2_HUMAN | ABCF2 |
| P45844 | ABCG1_HUMAN | ABCG1 |
| Q9UNQ0 | ABCG2_HUMAN | ABCG2 |
| O00400 | ACATN_HUMAN | SLC33A1 |
| P82251 | BAT1_HUMAN | SLC7A9 |
| Q8N1D0 | BWR1B_HUMAN | SLC22A18AS |
| Q12864 | CAD17_HUMAN | CDH17 |
| Q53 S 99 | CB083_HUMAN | C2orf83 |
| P51790 | CLCN3_HUMAN | CLCN3 |
| P51793 | CLCN4_HUMAN | CLCN4 |
| P51795 | CLCN5_HUMAN | CLCN5 |
| P51798 | CLCN7_HUMAN | CLCN7 |
| Q9NRU3 | CNNM1_HUMAN | CNNM1 |
| Q9H8M5 | CNNM2_HUMAN | CNNM2 |
| Q8NE01 | CNNM3_HUMAN | CNNM3 |
| Q6P4Q7 | CNNM4_HUMAN | CNNM4 |
| O15431 | COPT1_HUMAN | SLC31A1 |
| O15432 | COPT2_HUMAN | SLC31A2 |
| Q8WWI5 | CTL1_HUMAN | SLC44A1 |
| Q8IWA5 | CTL2_HUMAN | SLC44A2 |
| Q8N4M1 | CTL3_HUMAN | SLC44A3 |
| Q53GD3 | CTL4_HUMAN | SLC44A4 |
| Q8NCS7 | CTL5_HUMAN | SLC44A5 |
| P30825 | CTR1_HUMAN | SLC7A1 |
| P52569 | CTR2_HUMAN | SLC7A2 |
| Q8WY07 | CTR3_HUMAN | SLC7A3 |
| O43246 | CTR4_HUMAN | SLC7A4 |
| P43003 | EAA1_HUMAN | SLC1A3 |
| P43004 | EAA2_HUMAN | SLC1A2 |
| P43005 | EAA3_HUMAN | SLC1A1 |
| P48664 | EAA4_HUMAN | SLC1A6 |
| O00341 | EAA5_HUMAN | SLC1A7 |
| P55899 | FCGRN_HUMAN | FCGRT |
| Q9UPI3 | FLVC2_HUMAN | FLVCR2 |
| Q96A29 | FUCT1_HUMAN | SLC35C1 |
| O43826 | G6PT1_HUMAN | SLC37A4 |
| O95528 | GTR10_HUMAN | SLC2A10 |
| Q9BYW1 | GTR11_HUMAN | SLC2A11 |
| Q8TD20 | GTR12_HUMAN | SLC2Al2 |
| Q8TDB8 | GTR14_HUMAN | SLC2A14 |
| P11166 | GTR1_HUMAN | SLC2A1 |
| P11168 | GTR2_HUMAN | SLC2A2 |
| P11169 | GTR3_HUMAN | SLC2A3 |
| P14672 | GTR4_HUMAN | SLC2A4 |
| P22732 | GTR5_HUMAN | SLC2A5 |
| Q9UGQ3 | GTR6_HUMAN | SLC2A6 |
| Q6PXP3 | GTR7_HUMAN | SLC2A7 |
| Q9NY64 | GTR8_HUMAN | SLC2A8 |
| Q9NRM0 | GTR9_HUMAN | SLC2A9 |
| Q9HCP6 | HHATL_HUMAN | HHATL |
| Q6P1K1 | HRG1_HUMAN | SLC48A1 |
| Q12756 | KIF1A_HUMAN | KIF1A |
| Q6ZP29 | LAAT1_HUMAN | PQLC2 |
| Q15012 | LAP4A_HUMAN | LAPTM4A |
| Q01650 | LAT1_HUMAN | SLC7A5 |
| Q9GIP4 | LAT1L_HUMAN | SLC7A5P2 |
| Q8MH63 | LATIN_HUMAN | SLC7A5P1 |
| Q9UHI5 | LAT2_HUMAN | SLC7A8 |
| O75387 | LAT3_HUMAN | SLC43A1 |
| Q8N370 | LAT4_HUMAN | SLC43A2 |
| Q9NUN5 | LMBD1_HUMAN | LMBRD1 |
| Q9HOU3 | MAGT1_HUMAN | MAGT1 |
| Q8N8R3 | MCATL_HUMAN | SLC25A29 |
| Q96MC6 | MF14A_HUMAN | MFSD14A |
| Q9NYZ2 | MFRN1_HUMAN | SLC25A37 |
| Q96A46 | MFRN2_HUMAN | SLC25A28 |
| Q14728 | MFS10_HUMAN | MFSD10 |
| Q5TF39 | MFS4B_HUMAN | MFSD4B |
| Q6N075 | MFSD5_HUMAN | MFSD5 |
| Q9H2D1 | MFTC_HUMAN | SLC25A32 |
| Q8N4V1 | MMGT1_HUMAN | MMGT1 |
| Q8TF71 | MOT10_HUMAN | SLC16A10 |
| Q8NCK7 | MOT11_HUMAN | SLC16A11 |
| Q6ZSM3 | MOT12_HUMAN | SLC16Al2 |

TABLE 17-continued

| Exemplary transport proteins | | |
|---|---|---|
| UniProt ID | Entry name | Gene names (primary) |
| Q7RTY0 | MOT13_HUMAN | SLC16A13 |
| Q7RTX9 | MOT14_HUMAN | SLC16A14 |
| P53985 | MOT1_HUMAN | SLC16A1 |
| O60669 | MOT2_HUMAN | SLC16A7 |
| O95907 | MOT3_HUMAN | SLC16A8 |
| O15427 | MOT4_HUMAN | SLC16A3 |
| O15374 | MOTS_HUMAN | SLC16A4 |
| O15375 | MOT6_HUMAN | SLC16A5 |
| O15403 | MOT7_HUMAN | SLC16A6 |
| P36021 | MOT8_HUMAN | SLC16A2 |
| Q7RTY1 | MOT9_HUMAN | SLC16A9 |
| P33527 | MRP1_HUMAN | ABCC1 |
| Q92887 | MRP2_HUMAN | ABCC2 |
| O15438 | MRP3_HUMAN | ABCC3 |
| O15439 | MRP4_HUMAN | ABCC4 |
| O15440 | MRP5_HUMAN | ABCC5 |
| O95255 | MRP6_HUMAN | ABCC6 |
| Q9HD23 | MRS2_HUMAN | MRS2 |
| Q7RTP0 | NIPA1_HUMAN | NIPA1 |
| Q8N8Q9 | NIPA2_HUMAN | NIPA2 |
| Q6NVV3 | NIPA3_HUMAN | NIPAL1 |
| Q0D2K0 | NIPA4_HUMAN | NIPAL4 |
| P49281 | NRAM2_HUMAN | SLC11A2 |
| Q12908 | NTCP2_HUMAN | SLC10A2 |
| Q9Y619 | ORNT1_HUMAN | SLC25A15 |
| Q9B XI2 | ORNT2_HUMAN | SLC25A2 |
| Q86UW1 | OSTA_HUMAN | SLC51A |
| Q86UW2 | OSTB_HUMAN | SLC51B |
| Q04671 | P_HUMAN | OCA2 |
| Q96NT5 | PCFT_HUMAN | SLC46A1 |
| O75915 | PRAF3_HUMAN | ARL6IP5 |
| Q02094 | RHAG_HUMAN | RHAG |
| Q9H310 | RHBG_HUMAN | RHBG |
| Q9UBD6 | RHCG_HUMAN | RHCG |
| Q92681 | RSCA1_HUMAN | RSC1A1 |
| Q9BXP2 | S12A9_HUMAN | SLC12A9 |
| Q8WWT9 | S13A3_HUMAN | SLC13A3 |
| Q86YT5 | S13A5_HUMAN | SLC13A5 |
| P46059 | S15A1_HUMAN | SLC15A1 |
| Q16348 | S15A2_HUMAN | SLC15A2 |
| Q8IY34 | S15A3_HUMAN | SLC15A3 |
| Q8N697 | S15A4_HUMAN | SLC15A4 |
| Q6NT16 | S18B1_HUMAN | SLC18B1 |
| P41440 | S19A1_HUMAN | SLC19A1 |
| O60779 | S19A2_HUMAN | SLC19A2 |
| Q9BZV2 | S19A3_HUMAN | SLC19A3 |
| Q8WUM9 | S20A1_HUMAN | SLC20A1 |
| Q08357 | S20A2_HUMAN | SLC20A2 |
| O15245 | S22A1_HUMAN | SLC22A1 |
| O15244 | S22A2_HUMAN | SLC22A2 |
| O75751 | S22A3_HUMAN | SLC22A3 |
| Q9H015 | S22A4_HUMAN | SLC22A4 |
| O76082 | S22A5_HUMAN | SLC22A5 |
| Q4U2R8 | S22A6_HUMAN | SLC22A6 |
| Q9Y694 | S22A7_HUMAN | SLC22A7 |
| Q8TCC7 | S22A8_HUMAN | SLC22A8 |
| Q8IVM8 | S22A9_HUMAN | SLC22A9 |
| Q63ZE4 | S22AA_HUMAN | SLC22A10 |
| Q9NSA0 | S22AB_HUMAN | SLC22A11 |
| Q96S37 | S22AC_HUMAN | SLC22Al2 |
| Q9Y226 | S22AD_HUMAN | SLC22A13 |
| Q9Y267 | S22AE_HUMAN | SLC22A14 |
| Q8IZD6 | S22AF_HUMAN | SLC22A15 |
| Q86VW1 | S22AG_HUMAN | SLC22A16 |
| Q8WUG5 | S22AH_HUMAN | SLC22A17 |
| Q96BI1 | S22AI_HUMAN | SLC22A18 |
| A6NK97 | S22AK_HUMAN | SLC22A20 |
| Q6T423 | S22AP_HUMAN | SLC22A25 |
| Q9UHI7 | S23A1_HUMAN | SLC23A1 |
| Q9UGH3 | S23A2_HUMAN | SLC23A2 |
| Q6PIS1 | S23A3_HUMAN | SLC23A3 |
| Q86VD7 | S2542_HUMAN | SLC25A42 |
| Q86WA9 | S2611_HUMAN | SLC26A11 |
| Q9H2B4 | S26A1_HUMAN | SLC26A1 |
| P50443 | S26A2_HUMAN | SLC26A2 |
| O43511 | S26A4_HUMAN | SLC26A4 |

TABLE 17-continued

| Exemplary transport proteins | | |
|---|---|---|
| UniProt ID | Entry name | Gene names (primary) |
| Q9BXS9 | S26A6_HUMAN | SLC26A6 |
| Q8TE54 | S26A7_HUMAN | SLC26A7 |
| Q96RN1 | S26A8_HUMAN | SLC26A8 |
| Q7LBE3 | S26A9_HUMAN | SLC26A9 |
| O00337 | S28A1_HUMAN | SLC28A1 |
| O43868 | S28A2_HUMAN | SLC28A2 |
| Q99808 | S29A1_HUMAN | SLC29A1 |
| Q14542 | S29A2_HUMAN | SLC29A2 |
| Q9BZD2 | S29A3_HUMAN | SLC29A3 |
| Q7RTT9 | S29A4_HUMAN | SLC29A4 |
| P78382 | S35A1_HUMAN | SLC35A1 |
| P78381 | S35A2_HUMAN | SLC35A2 |
| Q9Y2D2 | S35A3_HUMAN | SLC35A3 |
| Q96G79 | S35A4_HUMAN | SLC35A4 |
| Q9BS91 | S35A5_HUMAN | SLC35A5 |
| P78383 | S35B1_HUMAN | SLC35B1 |
| Q8TB61 | S35B2_HUMAN | SLC35B2 |
| Q9H1N7 | S35B3_HUMAN | SLC35B3 |
| Q969S0 | S35B4_HUMAN | SLC35B4 |
| Q9NTN3 | S35D1_HUMAN | SLC35D1 |
| Q76EJ3 | S35D2_HUMAN | SLC35D2 |
| Q8IY50 | S35F3_HUMAN | SLC35F3 |
| Q7Z2H8 | S36A1_HUMAN | SLC36A1 |
| Q495M3 | S36A2_HUMAN | SLC36A2 |
| Q495N2 | S36A3_HUMAN | SLC36A3 |
| Q6YBV0 | S36A4_HUMAN | SLC36A4 |
| Q9H2H9 | S38A1_HUMAN | SLC38A1 |
| Q96QD8 | S38A2_HUMAN | SLC38A2 |
| Q99624 | S38A3_HUMAN | SLC38A3 |
| Q96916 | S38A4_HUMAN | SLC38A4 |
| Q8WUX1 | S38A5_HUMAN | SLC38A5 |
| Q8IZM9 | S38A6_HUMAN | SLC38A6 |
| Q9NVC3 | S38A7_HUMAN | SLC38A7 |
| A6NNN8 | S38A8_HUMAN | SLC38A8 |
| Q8NBW4 | S38A9_HUMAN | SLC38A9 |
| Q9HBR0 | S38AA_HUMAN | SLC38A10 |
| Q08A16 | S38AB_HUMAN | SLC38A11 |
| Q9NY26 | S39A1_HUMAN | SLC39A1 |
| Q9NP94 | S39A2_HUMAN | SLC39A2 |
| Q9BRY0 | S39A3_HUMAN | SLC39A3 |
| Q6P5W5 | S39A4_HUMAN | SLC39A4 |
| Q6ZMH5 | S39A5_HUMAN | SLC39A5 |
| Q13433 | S39A6_HUMAN | SLC39A6 |
| Q92504 | S39A7_HUMAN | SLC39A7 |
| Q9C0K1 | S39A8_HUMAN | SLC39A8 |
| Q9NUM3 | S39A9_HUMAN | SLC39A9 |
| Q9ULF5 | S39AA_HUMAN | SLC39A10 |
| Q8N1S5 | S39AB_HUMAN | SLC39A11 |
| Q504Y0 | S39AC_HUMAN | SLC39Al2 |
| Q96H72 | S39AD_HUMAN | SLC39A13 |
| Q15043 | S39AE_HUMAN | SLC39A14 |
| Q9NP59 | S40A1 _HUMAN | SLC40A1 |
| Q9Y2W3 | S45A1_HUMAN | SLC45A1 |
| Q9UMX9 | S45A2_HUMAN | SLC45A2 |
| Q8NBS3 | S4A11_HUMAN | SLC4A11 |
| Q9Y6M7 | S4A7_HUMAN | SLC4A7 |
| Q9NWF4 | S52A1_HUMAN | SLC52A1 |
| Q9HAB3 | S52A2_HUMAN | SLC52A2 |
| Q9NQ40 | S52A3_HUMAN | SLC52A3 |
| P48066 | S6A11_HUMAN | SLC6A11 |
| P48065 | S6Al2_HUMAN | SLC6Al2 |
| Q9NSD5 | S6A13_HUMAN | SLC6A13 |
| Q9UN76 | S6A14_HUMAN | SLC6A14 |
| Q9H2J7 | S6A15_HUMAN | SLC6A15 |
| Q9GZN6 | S6A16_HUMAN | SLC6A16 |
| Q9H1V8 | S6A17_HUMAN | SLC6A17 |
| Q96N87 | S6A18_HUMAN | SLC6A18 |
| Q695T7 | S6A19_HUMAN | SLC6A19 |
| Q9NP91 | S6A20_HUMAN | SLC6A20 |
| Q8TCU3 | S7A13_HUMAN | SLC7A13 |
| Q8TBB6 | S7A14_HUMAN | SLC7A14 |
| Q7OHW3 | SAMC_HUMAN | SLC25A26 |
| P43007 | SATT_HUMAN | SLC1A4 |
| P53794 | SC5A3_HUMAN | SLC5A3 |
| Q9Y289 | SC5A6_HUMAN | SLC5A6 |
| Q9GZV3 | SC5A7_HUMAN | SLC5A7 |
| Q8N695 | SC5A8_HUMAN | SLC5A8 |
| Q8WWX8 | SC5AB_HUMAN | SLC5A11 |
| Q1EHB4 | SC5AC_HUMAN | SLC5A12 |
| P30531 | SC6A1_HUMAN | SLC6A1 |
| P23975 | SC6A2_HUMAN | SLC6A2 |
| Q01959 | SC6A3_HUMAN | SLC6A3 |
| P31645 | SC6A4_HUMAN | SLC6A4 |
| Q9Y345 | SC6A5_HUMAN | SLC6A5 |
| P31641 | SC6A6_HUMAN | SLC6A6 |
| Q99884 | SC6A7_HUMAN | SLC6A7 |
| P48029 | SC6A8_HUMAN | SLC6A8 |
| P48067 | SC6A9_HUMAN | SLC6A9 |
| P46721 | SO1A2_HUMAN | SLCO1A2 |
| Q9Y6L6 | SO1B 1_HUMAN | SLCO1B 1 |
| Q9NPD5 | SO1B 3_HUMAN | SLCO1B3 |
| G3V0H7 | SO1B7_HUMAN | SLCO1B7 |
| Q9NYB5 | SO1C1_HUMAN | SLCO1C1 |
| Q92959 | SO2A1_HUMAN | SLCO2A1 |
| O94956 | SO2B 1_HUMAN | SLCO2B1 |
| Q9UIG8 | SO3A1_HUMAN | SLCO3A1 |
| Q96BDO | SO4A1_HUMAN | SLCO4A1 |
| Q6ZQN7 | SO4C1_HUMAN | SLCO4C1 |
| Q9H2Y9 | SO5A1_HUMAN | SLCO5A1 |
| Q86UG4 | SO6A1_HUMAN | SLCO6A1 |
| Q3KNW5 | SOAT_HUMAN | SLC10A6 |
| O95149 | SPN1_HUMAN | SNUPN |
| Q8N434 | SVOPL_HUMAN | SVOPL |
| Q9BRV3 | SWET1_HUMAN | SLC50A1 |
| Q03518 | TAP1_HUMAN | TAP1 |
| Q03519 | TAP2_HUMAN | TAP2 |
| Q13454 | TUSC3_HUMAN | TUSC3 |
| Q13336 | UT1_HUMAN | SLC14A1 |
| Q15849 | UT2_HUMAN | SLC14A2 |
| Q16572 | VACHT_HUMAN | SLC18A3 |
| Q9P2U7 | VGLU1_HUMAN | SLC17A7 |
| Q9P2U8 | VGLU2_HUMAN | SLC17A6 |
| Q8NDX2 | VGLU3_HUMAN | SLC17A8 |
| Q9H598 | VIAAT_HUMAN | SLC32A1 |
| P54219 | VMAT1_HUMAN | SLC18A1 |
| Q05940 | VMAT2_HUMAN | SLC18A2 |
| Q9UPY5 | XCT_HUMAN | SLC7A11 |
| Q9UM01 | YLAT1_HUMAN | SLC7A7 |
| Q92536 | YLAT2_HUMAN | SLC7A6 |
| Q6XR72 | ZNT10_HUMAN | SLC30A10 |
| Q9Y6M5 | ZNT1_HUMAN | SLC30A1 |
| Q9BRI3 | ZNT2_HUMAN | SLC30A2 |
| Q99726 | ZNT3_HUMAN | SLC30A3 |
| O14863 | ZNT4_HUMAN | SLC30A4 |
| Q8TAD4 | ZNT5_HUMAN | SLC30A5 |
| Q6NXT4 | ZNT6_HUMAN | SLC30A6 |
| Q8NEW0 | ZNT7_HUMAN | SLC30A7 |
| Q8IWU4 | ZNT8_HUMAN | SLC30A8 |
| Q6PML9 | ZNT9_HUMAN | SLC30A9 |

(viii) Chimeric Antigen Receptor Payloads

In some embodiments a membrane protein payload agent is or comprises a CAR, e.g., a first generation CAR or a nucleic acid encoding a first generation CAR. In some embodiments, a first generation CAR comprises an antigen binding domain, a transmembrane domain, and signaling domain. In some embodiments a signaling domain mediates downstream signaling during T-cell activation.

In some embodiments a membrane protein payload agent is or comprises a second generation CAR or a nucleic acid encoding a second generation CAR. In some embodiments a second generation CAR comprises an antigen binding domain, a transmembrane domain, and two signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation.

In some embodiments a membrane protein payload agent is or comprises a third generation CAR or a nucleic acid encoding a third generation CAR. In some embodiments, a third generation CAR comprises an antigen binding domain, a transmembrane domain, and at least three signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation. In some embodiments, a third generation CAR comprises at least two costimulatory domains. In some embodiments, the at least two costimulatory domains are not the same.

In some embodiments a membrane protein payload agent is or comprises a fourth generation CAR or a nucleic acid encoding a fourth generation CAR. In some embodiments a fourth generation CAR comprises an antigen binding domain, a transmembrane domain, and at least two, three, or four signaling domains. In some embodiments a signaling domain mediates downstream signaling during T-cell activation. In some embodiments a signaling domain is a costimulatory domain. In some embodiments, a costimulatory domain enhances cytokine production, CAR T-cell proliferation, and or CAR T-cell persistence during T cell activation.

In some embodiments, a first, second, third, or fourth generation CAR further comprises a domain which upon successful signaling of the CAR induces expression of a cytokine gene. In some embodiments, a cytokine gene is endogenous or exogenous to a target cell comprising a CAR which comprises a domain which upon successful signaling of the CAR induces expression of a cytokine gene. In some embodiments a cytokine gene encodes a pro-inflammatory cytokine. In some embodiments a cytokine gene encodes IL-1, IL-2, IL-9, IL-12, IL-18, TNF, or IFN-gamma, or functional fragment thereof. In some embodiments a domain which upon successful signaling of the CAR induces expression of a cytokine gene is or comprises a transcription factor or functional domain or fragment thereof. In some embodiments a domain which upon successful signaling of the CAR induces expression of a cytokine gene is or comprises a transcription factor or functional domain or fragment thereof. In some embodiments a transcription factor or functional domain or fragment thereof is or comprises a nuclear factor of activated T cells (NFAT), an NF-kB, or functional domain or fragment thereof. See, e.g., Zhang. C. et al., Engineering CAR-T cells. Biomarker Research. 5:22 (2017); WO 2016126608; Sha, H. et al. Chimaeric antigen receptor T-cell therapy for tumour immunotherapy. Bioscience Reports Jan. 27, 2017, 37 (1).

(a) CAR Antigen Binding Domains

In some embodiments, a CAR antigen binding domain is or comprises an antibody or antigen-binding portion thereof. In some embodiments, a CAR antigen binding domain is or comprises an scFv or Fab. In some embodiments a CAR antigen binding domain comprises an scFv or Fab fragment of a T-cell alpha chain antibody; T-cell β chain antibody; T-cell γ chain antibody; T-cell δ chain antibody; CCR7 antibody; CD3 antibody; CD4 antibody; CD5 antibody; CD7 antibody; CD8 antibody; CD11b antibody; CD11c antibody; CD16 antibody; CD19 antibody; CD20 antibody; CD21 antibody; CD22 antibody; CD25 antibody; CD28 antibody; CD34 antibody; CD35 antibody; CD40 antibody; CD45RA antibody; CD45RO antibody; CD52 antibody; CD56 antibody; CD62L antibody; CD68 antibody; CD80 antibody; CD95 antibody; CD117 antibody; CD127 antibody; CD133 antibody; CD137 (4-1 BB) antibody; CD163 antibody; F4/80 antibody; IL-4Ra antibody; Sca-1 antibody; CTLA-4 antibody; GITR antibody GARP antibody; LAP antibody; granzyme B antibody; LFA-1 antibody; or transferrin receptor antibody.

In some embodiments, an antigen binding domain binds to a cell surface antigen of a cell. In some embodiments, a cell surface antigen is characteristic of one type of cell. In some embodiments, a cell surface antigen is characteristic of more than one type of cell.

In some embodiments a CAR antigen binding domain binds a cell surface antigen characteristic of a T-cell. In some embodiments, an antigen characteristic of a T-cell may be a cell surface receptor, a membrane transport protein (e.g., an active or passive transport protein such as, for example, an ion channel protein, a pore-forming protein, etc.), a transmembrane receptor, a membrane enzyme, and/or a cell adhesion protein characteristic of a T-cell. In some embodiments, an antigen characteristic of a T-cell may be a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor.

In some embodiments, an antigen characteristic of a T-cell may be a T-cell receptor. In some embodiments, a T-cell receptor may be AKT1; AKT2; AKT3; ATF2; BCL10; CALM1; CD3D (CD3δ); CD3E (CD3ε); CD3G (CD3γ); CD4; CD8; CD28; CD45; CD80 (B7-1); CD86 (B7-2); CD247 (CD3ζ); CTLA4 (CD152); ELK1; ERK1 (MAPK3); ERK2; FOS; FYN; GRAP2 (GADS); GRB2; HLA-DRA; HLA-DRB1; HLA-DRB3; HLA-DRB4; HLA-DRB5; HRAS; IKBKA (CHUK); IKBKB; IKBKE; IKBKG (NEMO); IL2; ITPR1; ITK; JUN; KRAS2; LAT; LCK; MAP2K1 (MEK1); MAP2K2 (MEK2); MAP2K3 (MKK3); MAP2K4 (MKK4); MAP2K6 (MKK6); MAP2K7 (MKK7); MAP3K1 (MEKK1); MAP3K3; MAP3K4; MAP3K5; MAP3K8; MAP3K14 (NIK); MAPK8 (JNK1); MAPK9 (JNK2); MAPK10 (JNK3); MAPK11 (p38β); MAPK12 (p38γ); MAPK13 (p38δ); MAPK14 (p38α); NCK; NFAT1; NFAT2; NFKB1; NFKB2; NFKBIA; NRAS; PAK1; PAK2; PAK3; PAK4; PIK3C2B; PIK3C3 (VPS34); PIK3CA; PIK3CB; PIK3CD; PIK3R1; PKCA; PKCB; PKCM; PKCQ; PLCY1; PRF1 (Perforin); PTEN; RAC1; RAF1; RELA; SDF1; SHP2; SLP76; SOS; SRC; TBK1; TCRA; TEC; TRAF6; VAV1; VAV2; or ZAP70.

In some embodiments a CAR antigen binding domain binds an antigen characteristic of a cancer. In some embodiments an antigen characteristic of a cancer is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, histidine kinase associated receptor, Epidermal Growth Factor Receptors (EGFR) (including ErbB 1/EGFR, ErbB2/HER2, ErbB3/HER3, and ErbB4/HER4), Fibroblast Growth Factor Receptors (FGFR) (including FGF1, FGF2, FGF3, FGF4, FGF5, FGF6, FGF7, FGF18, and FGF21) Vascular Endothelial Growth Factor Receptors (VEGFR) (including VEGF-A, VEGF-B, VEGF-C, VEGF-D, and PIGF), RET Receptor and the Eph Receptor Family (including EphA1, EphA2, EphA3, EphA4, EphA5, EphA6, EphA7, EphA8, EphA9, EphA10, EphB1, EphB2. EphB3, EphB4, and EphB6), CXCR1, CXCR2, CXCR3, CXCR4, CXCR6, CCR1, CCR2, CCR3, CCR4, CCR5, CCR6, CCR8, CFTR, CIC-1, CIC-2, CIC-4, CIC-5, CIC-7, CIC-Ka, CIC-Kb, Bestrophins, TMEM16A, GAB A receptor, glycin receptor, ABC transporters, NAV1.1, NAV1.2, NAV1.3, NAV1.4, NAV1.5, NAV1.6, NAV1.7, NAV1.8, NAV1.9, sphingosin-1-phosphate receptor (S1P1R), NMDA channel, transmembrane protein, multi-span transmembrane protein, T-cell receptor motifs; T-cell alpha chains; T-cell β chains; T-cell γ chains; T-cell δ chains; CCR7; CD3; CD4; CD5; CD7; CD8; CD11b; CD11c; CD16; CD19; CD20; CD21; CD22; CD25; CD28; CD34; CD35; CD40; CD45RA; CD45RO; CD52; CD56; CD62L; CD68; CD80; CD95; CD117; CD127; CD133; CD137 (4-1 BB); CD163; F4/80; IL-4Ra; Sca-1; CTLA-4; GITR; GARP; LAP; granzyme B; LFA-1; transferrin receptor; NKp46, perforin, CD4+; Th1; Th2; Th17; Th40; Th22; Th9; Tfh, Canonical Treg. FoxP3+; Tr1; Th3; Treg17; $T_{RE}G$; CDCP1, NT5E, EpCAM, CEA, gpA33, Mucins, TAG-72, Carbonic anhydrase IX, PSMA, Folate binding protein, Gangliosides (e.g., CD2, CD3, GM2), Lewis-$\gamma^2$, VEGF, VEGFR 1/2/3, αVβ3, α5β1, ErbB 1/EGFR, ErbB 1/HER2, ErB3, c-MET, IGF1R, EphA3, TRAIL-R1, TRAIL-R2, RANKL, FAP, Tenascin, PDL-1, BAFF, HDAC, ABL, FLT3, KIT, MET, RET, IL-1β, ALK, RANKL, mTOR, CTLA-4, IL-6, IL-6R, JAK3, BRAF, PTCH, Smoothened, PIGF, ANPEP, TIMP1, PLAUR, PTPRJ, LTBR, or ANTXR1, Folate receptor alpha (FRa), ERBB2 (Her2/neu), EphA2, IL-13Ra2, epidermal growth factor receptor (EGFR), Mesothelin, TSHR, CD19, CD123, CD22, CD30, CD171, CS-1, CLL-1, CD33, EGFRvIII, GD2, GD3, BCMA, MUC16 (CA125), L1CAM, LeY, MSLN, IL13Rα1, L1-CAM, Tn Ag, prostate specific membrane antigen (PSMA), ROR1, FLT3, FAP, TAG72, CD38, CD44v6, CEA, EPCAM, B7H3, KIT, interleukin-11 receptor a (IL-11Ra), PSCA, PRSS21, VEGFR2, LewisY, CD24, platelet-derived growth factor receptor-beta (PDGFR-beta), SSEA-4, CD20, MUC1, NCAM, Prostase, PAP, ELF2M, Ephrin B2, IGF-1 receptor, CAIX, LMP2, gplOO, bcr-abl, tyrosinase, Fucosyl GM1, sLe, GM3, TGS5, HMWMAA, o-acetyl-GD2, Folate receptor beta, TEM1/CD248, TEM7R, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6, E7, ETV6-AML, sperm protein 17, XAGE1, Tie 2, MAD-CT-1, MAD-CT-2, Fos-related antigen 1, p53, p53 mutant, prostein, survivin, telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYPIB I, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, IGLL1, a neoantigen, CD133, CD15, CD184, CD24, CD56, CD26, CD29, CD44, HLA-A, HLA-B, HLA-C, (HLA-A, B,C) CD49f, CD151 CD340, CD200, tkrA, trkB, or trkC, or an antigenic fragment or antigenic portion thereof.

In some embodiments a CAR antigen binding domain binds an antigen characteristic of an infectious disease (e.g. a viral infection or a bacterial infection). In some embodiments an antigen is characteristic of an infectious disease selected from HIV, hepatitis B virus, hepatitis C virus, Human herpes virus, Human herpes virus 8 (HHV-8, Kaposi sarcoma-associated herpes virus (KSHV)), Human T-lymphotrophic virus-1 (HTLV-1), Merkel cell polyomavirus (MCV), Simian virus 40 (SV40), Epstein-Barr virus, CMV, human papillomavirus. In some embodiments an antigen characteristic of an infectious disease is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor. In some embodiments, a CAR antigen binding domain binds an antigen characteristic of an infectious disease, wherein the antigen is selected from HIV Env, gp120, or CD4-induced epitope on HIV-1 Env. See, e.g., WO2015/077789, the contents of which are herein incorporated by reference. In some embodiments, a CAR antigen binding domain comprises CD4 or an HIV binding fragment thereof.

In some embodiments a CAR antigen binding domain binds an antigen characteristic of an autoimmune or inflammatory disorder. In some embodiments the antigen is characteristic of an autoimmune or inflammatory disorder selected from chronic graft-vs-host disease (GVHD), lupus, arthritis, immune complex glomerulonephritis, goodpasture, uveitis, hepatitis, systemic sclerosis or scleroderma, type I diabetes, multiple sclerosis, cold agglutinin disease, Pemphigus vulgaris, Grave's disease, autoimmune hemolytic anemia, Hemophilia A, Primary Sjogren's Syndrome, thrombotic thrombocytopenia purrpura, neuromyelits optica, Evan's syndrome, IgM mediated neuropathy, cyroglobulinemia, dermatomyositis, idiopathic thrombocytopenia, ankylosing spondylitis, bullous pemphigoid, acquired angioedema, chronic urticarial, antiphospholipid demyelinating polyneuropathy, and autoimmune thrombocytopenia or neutropenia or pure red cell aplasias, while exemplary non-limiting examples of alloimmune diseases include allosensitization (see, for example, Blazar et al., 2015, Am. J. Transplant, 15(4):931-41) or xenosensitization from hematopoietic or solid organ transplantation, blood transfusions, pregnancy with fetal allosensitization, neonatal alloimmune thrombocytopenia, hemolytic disease of the newborn, sensitization to foreign antigens such as can occur with replacement of inherited or acquired deficiency disorders treated with enzyme or protein replacement therapy, blood products, and gene therapy. In some embodiments an antigen characteristic of an autoimmune or inflammatory disorder is selected from a cell surface receptor, an ion channel-linked receptor, an enzyme-linked receptor, a G protein-coupled receptor, receptor tyrosine kinase, tyrosine kinase associated receptor, receptor-like tyrosine phosphatase, receptor serine/threonine kinase, receptor guanylyl cyclase, or histidine kinase associated receptor. In some embodiments, a CAR antigen binding domain binds to a ligand expressed on B cells, plasma cells, or plasmablasts. In some embodiments, a CAR antigen binding domain binds an antigen characteristic of an autoimmune or inflammatory disorder, wherein the antigen is selected from CD10, CD19, CD20, CD22, CD24, CD27, CD38, CD45R, CD138, CD319, BCMA, CD28, TNF, interferon receptors, GM-CSF, ZAP-70, LFA-1, CD3 gamma, CD5 or CD2. See US 2003/0077249; WO 2017/058753; WO 2017/058850, the contents of which are herein incorporated by reference.

(b) CAR Transmembrane Domains

In some embodiments a CAR comprises a transmembrane domain. In some embodiments a CAR comprises at least a transmembrane region of the alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, or functional variant thereof. In some embodiments a CAR comprises at least a transmembrane region of CD8α, CD8β, 4-1BB/CD137, CD28, CD34, CD4, FcεRIγ, CD16, OX40/CD134, CD3ζ, CD3ε, CD3γ, CD3δ, TCRα, TCRβ, TCRζ, CD32, CD64, CD64, CD45, CD5, CD9, CD22, CD37, CD80, CD86, CD40, CD40L/CD154, VEGFR2, FAS, and FGFR2B, or functional variant thereof.

(c) CAR Signaling Domains

In some embodiments a CAR comprises a signaling domain of one or more of B7-1/CD80; B7-2/CD86; B7-H1/PD-L1; B7-H2; B7-H3; B7-H4; B7-H6; B7-H7; BTLA/CD272; CD28; CTLA-4; Gi24/VISTA/B7-H5; ICOS/CD278; PD-1; PD-L2/B7-DC; PDCD6); 4-1BB/TNFSF9/CD137; 4-1BB Ligand/TNFSF9; BAFF/BLyS/TNFSF13B; BAFF R/TNFRSF13C; CD27/TNFRSF7; CD27 Ligand/TNFSF7; CD30/TNFRSF8; CD30 Ligand/TNFSF8; CD40/TNFRSF5; CD40/TNFSF5; CD40 Ligand/TNFSF5; DR3/TNFRSF25; GITR/TNFRSF18; GITR Ligand/TNFSF18; HVEM/TNFRSF14; LIGHT/TNFSF14; Lymphotoxin-alpha/TNF-beta; OX40/TNFRSF4; OX40 Ligand/TNFSF4; RELT/TNFRSF19L; TACI/TNFRSF13B; TL1A/TNFSF15; TNF-alpha; TNF RII/TNFRSF1B); 2B4/CD244/SLAMF4; BLAME/SLAMF8; CD2; CD2F-10/SLAMF9; CD48/SLAMF2; CD58/LFA-3; CD84/SLAMF5; CD229/SLAMF3; CRACC/SLAMF7; NTB-A/SLAMF6; SLAM/CD150); CD2; CD7; CD53; CD82/Kai-1; CD90/Thy1; CD96; CD160; CD200; CD300a/LMIR1; HLA Class I; HLA-DR; Ikaros; Integrin alpha 4/CD49d; Integrin alpha 4 beta 1; Integrin alpha 4 beta 7/LPAM-1; LAG-3; TCL1A; TCL1B; CRTAM; DAP12; Dectin-1/CLEC7A; DPPIV/CD26; EphB6; TIM-1/KIM-1/HAVCR; TIM-4; TSLP; TSLP R; lymphocyte function associated antigen-1 (LFA-1); NKG2C, a CD3 zeta domain, an immunoreceptor tyrosine-based activation motif (ITAM), or functional variant thereof.

In some embodiments a CAR comprises a signaling domain which is a costimulatory domain. In some embodiments a CAR comprises a second costimulatory domain. In some embodiments a CAR comprises at least two costimulatory domains. In some embodiments a CAR comprises at least three costimulatory domains. In some embodiments a CAR comprises a costimulatory domain selected from one or more of CD27, CD28, 4-1BB, CD134/OX40, CD30, CD40, PD-1, ICOS, lymphocyte function-associated antigen-1 (LFA-1), CD2, CD7, LIGHT, NKG2C, B7-H3, a ligand that specifically binds with CD83.

In some embodiments, a CAR comprises a CD3 zeta domain or an immunoreceptor tyrosine-based activation motif (ITAM), or functional variant thereof. In some embodiments, a CAR comprises a (i) a CD3 zeta domain, or an immunoreceptor tyrosine-based activation motif (ITAM), or functional variant thereof; and (ii) a CD28 domain, or a 4-1BB domain, or functional variant thereof. In some embodiments, a CAR comprises a (i) a CD3 zeta domain, or an immunoreceptor tyrosine-based activation motif (ITAM), or functional variant thereof; (ii) a CD28 domain or functional variant thereof; and (iii) a 4-1BB domain, or a CD134 domain, or functional variant thereof. In some embodiments, a CAR comprises a (i) a CD3 zeta domain, or an immunoreceptor tyrosine-based activation motif (ITAM), or functional variant thereof; (ii) a CD28 domain or functional variant thereof; (iii) a 4-1BB domain, or a CD134 domain, or functional variant thereof; and (iv) a cytokine or costimulatory ligand transgene.

(d) CAR Spacers

In some embodiments a CAR comprises one or more spacers. In some embodiments a CAR comprises a spacer between the antigen binding domain and the transmembrane domain. In some embodiments a CAR comprises a spacer between the transmembrane domain and the intracellular signaling domain.

(e) CAR Membrane Protein Payload Agents

In addition to the CARs described herein, various chimeric antigen receptors and nucleotide sequences encoding the same are known in the art and would be suitable for fusosomal delivery and reprogramming of target cells in vivo and in vitro as described herein. See, e.g., WO2013040557; WO2012079000; WO2016030414; Smith T, et al., Nature Nanotechnology. 2017. DOI: 10.1038/NNANO.2017.57, the disclosures of which are herein incorporated by reference.

In some embodiments a fusosome comprising a membrane protein payload agent which is or comprises a CAR or a nucleic acid encoding a CAR (e.g., a DNA, a gDNA, a cDNA, an RNA, a pre-MRNA, an mRNA, an miRNA, an siRNA, etc.) is delivered to a target cell. In some embodiments the target cell is an effector cell, e.g., a cell of the immune system that expresses one or more Fc receptors and mediates one or more effector functions. In some embodiments, a target cell may include, but may not be limited to, one or more of a monocyte, macrophage, neutrophil, dendritic cell, eosinophil, mast cell, platelet, large granular lymphocyte, Langerhans' cell, natural killer (NK) cell, T-lymphocyte (e.g., T-cell), a Gamma delta T cell, B-lymphocyte (e.g., B-cell) and may be from any organism including but not limited to humans, mice, rats, rabbits, and monkeys.

Nuclear Protein Payload Agents

In some embodiments, the payload agent is or compromises a nuclear protein payload agent or functional fragment, variant, or homolog thereof, or a nucleic acid encoding it. In some embodiments a nuclear protein payload agent is or compromises a protein selected from Table 17-1, or functional fragment, variant, or homolog thereof, or a nucleic acid encoding it. In embodiments, a nuclear protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 17-1, or a nucleic acid encoding the same. In embodiments, the nuclear protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 17-1. In some embodiments, the payload agent is or comprises a protein that localizes to the nucleolus or a nuclear body, or a nucleic acid encoding the same. In some embodiments, the payload agent is or comprises a structural protein, transcriptional activator, transcriptional repressor, epigenetic modifier, histone acetyltransferase, histone deacetylase, histone methyltransferase, histone demethylase, DNA modifying enzyme, RNA splicing factor, or genome homeostasis protein, or a nucleic acid encoding the same.

TABLE 17-1

Exemplary nuclear proteins

| UniProt ID | Entry name | Gene names | Localization/Subtype |
|---|---|---|---|
| P22087 | fibrillarin | FBL | Nucleolus |
| Q8N9T8 | KRI1 homolog | KRI1 | Nucleolus |
| Q9H8H0 | nucleolar protein 11 | NOL11 | Nucleolus |
| P17480 | upstream binding transcription factor | UBTF | Nucleolus |
| Q99848 | EBNA1 binding protein 2 | EBNA1BP2 | Nucleolus |
| P38432 | coilin | COIL | Nuclear Bodies |
| P29590 | promyelocytic leukemia | PML | Nuclear Bodies |

TABLE 17-1-continued

| Exemplary nuclear proteins | | | |
|---|---|---|---|
| UniProt ID | Entry name | Gene names | Localization/Subtype |
| Q9Y3Y2 | chromatin target of PRMT1 | CHTOP | Nuclear Bodies |
| Q9BSI4 | TERF1 interacting nuclear factor 2 | TINF2 | Nuclear Bodies |
| P00519 | ABL proto-oncogene 1, non-receptor tyrosine kinase | ABL1 | Nuclear Bodies |
| P20700 | lamin B1 | LMNB1 | Structural Proteins |
| P07199 | centromere protein B | CENPB | Structural Proteins |
| P07305 | H1 histone family member 0 | H1F0 | Structural Proteins |
| Q8NG31 | kinetochore scaffold 1 | KNL1 | Structural Proteins |
| Q16576 | RB binding protein 7, chromatin remodeling factor | RbAp46 | Structural Proteins |
| P40763 | signal transducer and activator of transcription 3 | STAT3 | Transcriptional Activator |
| Q9BZS1 | forkhead box P3 | FOXP3 | Transcriptional Activator |
| P41235 | hepatocyte nuclear factor 4 alpha | HNF4 | Transcriptional Activator |
| Q01196 | runt related transcription factor 1 | RUNX1 | Transcriptional Activator |
| Q9UJU2 | lymphoid enhancer binding factor 1 | LEF1 | Transcriptional Activator |
| Q9H334 | forkhead box P1 | FOXP1 | Transcriptional Repressor |
| O14529 | cut like homeobox 2 | CUX2 | Transcriptional Repressor |
| P14859 | POU class 2 homeobox 1 | POU2F1 | Transcriptional Repressor |
| O95343 | SIX homeobox 3 | SIX3 | Transcriptional Repressor |
| Q04206 | RELA proto-oncogene, NF-kB subunit | RELA | Transcriptional Repressor |
| Q12824 | SWI/SNF related, matrix associated, actin dependent regulator of chromatin, subfamily b, member 1 | SMARCB1 | Epigenetic Modifier |
| Q9P2D1 | chromodomain helicase DNA binding protein 7 | CHD7 | Epigenetic Modifier |
| Q9NRG0 | chromatin accessibility complex subunit 1 | CHRAC1 | Epigenetic Modifier |
| Q9NQ94 | APOBEC1 complementation factor | ACF | Epigenetic Modifier |
| O60885 | bromodomain containing 4 | BRD4 | Epigenetic Modifier |
| Q99966 | Cbp/p300 interacting transactivator with Glu/Asp rich carboxy-terminal domain 1 | CITED1 | Histone Acetyltransferase |
| Q92830 | lysine acetyltransferase 2A | KAT2A | Histone Acetyltransferase |
| O14929 | histone acetyltransferase 1 | HAT1 | Histone Acetyltransferase |
| O75529 | TATA-box binding protein associated factor 5 like | TAF5L | Histone Acetyltransferase |
| Q92993 | lysine acetyltransferase 5 | KAT5 | Histone Acetyltransferase |
| Q96EB6 | sirtuin 1 | SIRT1 | Histone Deacetylase |
| Q8IXJ6 | sirtuin 2 | SIRT2 | Histone Deacetylase |
| Q96DB2 | histone deacetylase 11 | HDAC11 | Histone Deacetylase |
| O15379 | histone deacetylase 3 | HDAC3 | Histone Deacetylase |
| Q9UBN7 | histone deacetylase 6 | HDAC6 | Histone Deacetylase |
| Q9NR48 | ASH1 like histone lysine methyltransferase | ASH1L | Histone Methyltransferase |

TABLE 17-1-continued

| Exemplary nuclear proteins | | | |
|---|---|---|---|
| UniProt ID | Entry name | Gene names | Localization/Subtype |
| Q8TEK3 | DOT1 like histone lysine methyltransferase | DOT1L | Histone Methyltransferase |
| Q96L73 | nuclear receptor binding SET domain protein 1 | NSD1 | Histone Methyltransferase |
| Q01105 | SET nuclear proto-oncogene | SET | Histone Methyltransferase |
| Q03164 | lysine methyltransferase 2A | KMT2A | Histone Methyltransferase |
| Q9Y2K7 | lysine demethylase 2A | KDM2A | Histone Demethylase |
| O60341 | lysine demethylase 1A | KDM1A | Histone Demethylase |
| Q9Y4C1 | lysine demethylase 3A | KDM3A | Histone Demethylase |
| O94953 | lysine demethylase 4B | KDM4B | Histone Demethylase |
| P41229 | lysine demethylase 5C | KDM5C | Histone Demethylase |
| P26358 | DNA methyltransferase 1 | DNMT1 | DNA Modifying Enzymes |
| Q9Y6K1 | DNA methyltransferase 3 alpha | DNMT3A | DNA Modifying Enzymes |
| Q9NZK5 | adenosine deaminase 2 | ADA2 | DNA Modifying Enzymes |
| P55265 | adenosine deaminase, RNA specific | ADAR | DNA Modifying Enzymes |
| P41238 | apolipoprotein B mRNA editing enzyme catalytic subunit 1 | APOBEC1 | DNA Modifying Enzymes |
| Q15020 | spliceosome associated factor 3, U4/U6 recycling protein | SART3 | RNA splicing |
| Q9BWU1 | cyclin dependent kinase 19 | CDK11 | RNA splicing |
| Q9UK58 | cyclin L1 | CCNL1 | RNA splicing |
| Q8WWY3 | pre-mRNA processing factor 31 | PRPF31 | RNA splicing |
| Q12874 | splicing factor 3a subunit 3 | SF3A3 | RNA splicing |
| Q14676 | mediator of DNA damage checkpoint 1 | MDC1 | Genome Homeostasis |
| Q13315 | ATM serine/threonine kinase | ATM | Genome Homeostasis |
| P09874 | poly(ADP-ribose) polymerase 1 | PARP1 | Genome Homeostasis |
| P11387 | DNA topoisomerase I | TOP1 | Genome Homeostasis |
| P49917 | DNA ligase 4 | LIG4 | Genome Homeostasis |

Organellar Protein Payload Agents

In some embodiments, the payload agent is or compromises an organellar protein payload agent or functional fragment, variant, or homolog thereof, or a nucleic acid encoding it. In some embodiments an organellar protein payload agent is or compromises a protein selected from Table 17-2, or functional fragment, variant, or homolog thereof, or a nucleic acid encoding it. In embodiments, an organellar protein payload agent comprises a protein having a sequence at least 85%, 86%, 87%, 88%, 89%, 90%, 91%, 92%, 93%, 94%, 95%, 96%, 97%, or 99% identical to the polypeptide sequence of a protein of Table 17-2, or a nucleic acid encoding the same. In embodiments, the organellar protein payload agent comprises a nucleic acid having a sequence at least 85%, 86%, 87%, 88%, 89%, 90%, 91%, 92%, 93%, 94%, 95%, 96%, 97%, or 99% identical to the nucleic acid sequence of a gene of Table 17-2. In embodiments, the organellar protein payload agent localizes to an intracellular compartment, e.g., as described herein (e.g., as listed in Table 17-2). In embodiments, the organellar protein payload agent localizes to the endoplasmic reticulum, mitochondria, peroxisome, Golgi apparatus, lipid droplets, plasma membrane, stress granule, or cytoskeleton. In embodiments, the organellar protein payload agent comprises a localization signal for an intracellular compartment, e.g., as described herein (e.g., as listed in Table 17-2). In embodiments, the organellar protein payload agent comprises a localization signal for one or more of (e.g., 1, 2, 3, or 4 of) the endoplasmic reticulum, mitochondria, peroxisome, Golgi apparatus, lipid droplets, plasma membrane, stress granule, or cytoskeleton.

TABLE 17-2

Exemplary organellar proteins

| UniProt ID | Entry name | Gene names | Localization/ Subtype |
|---|---|---|---|
| P51572 | B cell receptor associated protein 31 | BCAP31 | Endoplasmic Reticulum |
| P27824 | calnexin | CANX | Endoplasmic Reticulum |
| O43731 | KDEL endoplasmic reticulum protein retention receptor 3 ("KDEL" disclosed as SEQ ID NO: 125) | KDELR3 | Endoplasmic Reticulum |
| Q9NQC3 | reticulon 4 | RTN4 | Endoplasmic Reticulum |
| P61619 | Sec61 translocon alpha 1 subunit | SEC61A1 | Endoplasmic Reticulum |
| O14983 | Sarcoplasmic/endoplasmic reticulum calcium ATPase 1 | ATP2A1 | Endoplasmic Reticulum |
| Q9GZP9 | Derlin-2 | DERL2 | Endoplasmic Reticulum |
| Q8N6R1 | Stress-associated endoplasmic reticulum protein 2 | SERP2 | Endoplasmic Reticulum |
| Q14257 | Reticulocalbin-2 | RCN2 | Endoplasmic Reticulum |
| Q6DD88 | Atlastin-3 | ATL3 | Endoplasmic Reticulum |
| P99999 | cytochrome c, somatic | CYCS | Mitochondrion |
| O43615 | translocase of inner mitochondrial membrane 44 | TIMM44 | Mitochondrion |
| O96008 | translocase of outer mitochondrial membrane 40 | TOMM40 | Mitochondrion |
| P45880 | voltage dependent anion channel 2 | VDAC2 | Mitochondrion |
| Q96D53 | coenzyme Q8B | COQ8B | Mitochondrion |
| P24752 | Acetyl-CoA acetyltransferase, mitochondrial | ACAT1 | Mitochondrion |
| O75390 | Citrate synthase, mitochondrial | CS | Mitochondrion |
| O14548 | Cytochrome c oxidase subunit 7A-related protein, mitochondrial | COX7A2L | Mitochondrion |
| P07954 | Fumarate hydratase, mitochondrial | FH | Mitochondrion |
| P22570 | NADPH:adrenodoxin oxidoreductase, mitochondrial | FDXR | Mitochondrion |
| Q07820 | Induced myeloid leukemia cell differentiation protein Mcl-1 | MCL1 | Mitochondrion |
| Q9P0J0 | NADH dehydrogenase [ubiquinone] 1 alpha subcomplex subunit 13 | NDUFA13 | Mitochondrion |
| Q00059 | Transcription factor A, mitochondrial | TFAM | Mitochondrion |
| Q8WVX9 | fatty acyl-CoA reductase 1 | FAR1 | Peroxisome |
| P09110 | acetyl-CoA acyltransferase 1 | ACAA1 | Peroxisome |
| P28288 | ATP binding cassette subfamily D member 3 | ABCD3 | Peroxisome |

TABLE 17-2-continued

Exemplary organellar proteins

| UniProt ID | Entry name | Gene names | Localization/ Subtype |
|---|---|---|---|
| P51659 | hydroxysteroid 17-beta dehydrogenase 4 | HSD17B4 | Peroxisome |
| O75381 | peroxisomal biogenesis factor 14 | PEX14 | Peroxisome |
| P22307 | Non-specific lipid-transfer protein | SCP2 | Peroxisome |
| P40855 | Peroxisomal biogenesis factor 19 | PEX19 | Peroxisome |
| O75521 | Enoyl-CoA delta isomerase 2 | ECI2 | Peroxisome |
| Q5T8D3 | Acyl-CoA-binding domain-containing protein 5 | ACBD5 | Peroxisome |
| Q92805 | golgin A1 | GOLGA1 | Golgi apparatus |
| O00461 | golgi integral membrane protein 4 | GOLIM4 | Golgi apparatus |
| Q9HD26 | golgi associated PDZ and coiled-coil motif containing | GOPC | Golgi apparatus |
| Q96ET8 | trans-golgi network vesicle protein 23 homolog C | TVP23C | Golgi apparatus |
| Q9NXF8 | zinc finger DHHC-type containing 7 | ZDHHC7 | Golgi apparatus |
| P48444 | Coatomer subunit delta | ARCN1 | Golgi apparatus |
| Q9NW68 | BSD domain-containing protein 1 | BSDC1 | Golgi apparatus |
| P16671 | Platelet glycoprotein 4 | CD36 | Golgi apparatus |
| P83436 | Conserved oligomeric Golgi complex subunit 7 | COG7 | Golgi apparatus |
| O14579 | Coatomer subunit epsilon | COPE | Golgi apparatus |
| Q92520 | Protein FAM3C | FAM3C | Golgi apparatus |
| Q9BYC5 | Alpha-(1,6)-fucosyltransferase | FUT8 | Golgi apparatus |
| O60763 | General vesicular transport factor p115 | USO1 | Golgi apparatus |
| Q9HC07 | Transmembrane protein 165 | TMEM165 | Golgi apparatus |
| Q9P1Q0 | Vacuolar protein sorting-associated protein 54 | VPS54 | Golgi apparatus |
| Q9GZM5 | Protein YIPF3 | YIPF3 | Golgi apparatus |
| Q96CS3 | Fas associated factor family member 2 | FAF2 | Lipid Droplets |
| Q7L5N7 | lysophosphatidylcholine acyltransferase 2 | LPCAT2 | Lipid Droplets |
| Q15738 | NAD(P) dependent steroid dehydrogenase-like | NSDHL | Lipid Droplets |
| O60664 | perilipin 3 | PLIN3 | Lipid Droplets |
| Q96AD5 | patatin like phospholipase domain containing 2 | PNPLA2 | Lipid Droplets |
| P55283 | cadherin 4 | CDH4 | Plasma membrane |
| P35222 | catenin beta 1 | CTNNB1 | Plasma membrane |
| P00533 | epidermal growth factor receptor | EGFR | Plasma membrane |
| P15311 | ezrin | EZR | Plasma membrane |
| Q12846 | syntaxin 4 | STX4 | Plasma membrane |
| Q9UNQ0 | ATP-binding cassette sub-family G member 2 | ABCG2 | Plasma membrane |
| Q8WXE0 | Caskin-2 | CASKIN2 | Plasma membrane |
| P14923 | Junction plakoglobin | JUP | Plasma membrane |
| P13591 | Neural cell adhesion molecule 1 | NCAM | Plasma membrane |
| Q96RD7 | Pannexin-1 | PANX1 | Plasma membrane |
| P11166 | Solute carrier family 2, facilitated glucose transporter member 1 | SLC2A1 | Plasma membrane |
| Q8TAV4 | Stomatin-like protein 3 | STOML3 | Plasma membrane |
| P35637 | FUS RNA binding protein | FUS | Stress granule |
| Q13148 | TAR DNA binding protein | TARDBP | Stress granule |
| Q92804 | TATA-box binding protein associated factor 15 | TAF15 | Stress granule |

TABLE 17-2-continued

| Exemplary organellar proteins | | | |
|---|---|---|---|
| UniProt ID | Entry name | Gene names | Localization/ Subtype |
| Q01844 | EWS RNA binding protein 1 | EWSR1 | Stress granule |
| Q9NQI0 | DEAD-box helicase 4 ("DEAD" is disclosed as SEQ ID NO: 766) | DDX4 | Stress granule |
| Q13148 | TAR DNA-binding protein 43 | TDP-43 | Stress granule |
| P09651 | Heterogeneous nuclear ribonucleoprotein A1 | hnRNPA1 | Stress granule |
| P22626 | Heterogeneous nuclear ribonucleoproteins A2/B1 | hnRNPA2 | Stress granule |
| P31483 | Nucleoly sin TIA-1 isoform p40 | TIA-1 | Stress granule |
| Q9UPV0 | centrosomal protein 164 | CEP164 | Cytoskeleton |
| Q9UHG0 | doublecortin domain containing 2 | DCDC2 | Cytoskeleton |
| P05787 | keratin 8 | KRT8 | Cytoskeleton |
| P35580 | myosin heavy chain 10 | MYH10 | Cytoskeleton |
| P60709 | actin beta | ACTB | Cytoskeleton |
| Q49A88 | Coiled-coil domain-containing protein 14 | CCDC14 | Cytoskeleton |
| P05783 | Keratin, type I cytoskeletal 18 | KRT18 | Cytoskeleton |
| O95613 | Pericentrin | PCNT | Cytoskeleton |
| Q71U36 | Tubulin alpha-1A chain | TUBA1A | Cytoskeleton |
| P68133 | Actin, alpha skeletal muscle | ACTA1 | Cytoskeleton |

Secreted Payload Agents, e.g., Secreted Protein Payload Agents

Payload agents, e.g., protein payload agents, can also be targeted for secretion. In some embodiments, the methods and compositions described herein can be used to target payloads to the lumen of an organelle (e.g. a Golgi apparatus, secretory vesicle) after translation in the ER. In some embodiments, a secreted protein payload agent comprises a secreted protein or a nucleic acid encoding it.

Chondrisomes

In some embodiments, a fusosome or fusosome composition further comprises a chondrisome or chondrisome preparation. In some embodiments, a fusosome or fusosome composition comprises a modified chondrisome preparation derived from a cellular source of mitochondria. In some embodiments, a fusosome or fusosome composition comprises a chondrisome preparation expressing an exogenous protein. In some embodiments, the exogenous protein is exogenous to said mitochondria. In some embodiments, the exogenous protein is exogenous to said cellular source of mitochondria. Additional features and embodiments including chondrisomes, chondrisome preparations, methods, and uses are contemplated by the invention, e.g., as described in international application, PCT/US16/64251.

Immunogenicity

In some embodiments of any of the aspects described herein, the fusosome composition is substantially non-immunogenic. Immunogenicity can be quantified, e.g., as described herein.

In some embodiments, the fusosome composition has membrane symmetry of a cell which is, or is known to be, substantially non-immunogenic, e.g., a stem cell, mesenchymal stem cell, induced pluripotent stem cell, embryonic stem cell, sertoli cell, or retinal pigment epithelial cell. In some embodiments, the fusosome has an immunogenicity no more than 5%, 10%, 20%, 30%, 40%, or 50% greater than the immunogenicity of a stem cell, mesenchymal stem cell, induced pluripotent stem cell, embryonic stem cell, sertoli cell, or retinal pigment epithelial cell as measured by an assay described herein.

In some embodiments, the fusosome composition comprises elevated levels of an immunosuppressive agent as compared to a reference cell, e.g., an unmodified cell otherwise similar to the source cell, or a Jurkat cell. In some embodiments, the elevated level is at least 5%, 10%, 20%, 30%, 40%, 50%, 60%, 70%, 80%, 90%, 2-fold, 3-fold, 5-fold, 10-fold, 20-fold, 50-fold, or 100-fold. In some embodiments, the fusosome composition comprises an immunosuppressive agent that is absent from the reference cell. In some embodiments, the fusosome composition comprises reduced levels of an immune activating agent as compared to a reference cell, e.g., an unmodified cell otherwise similar to the source cell, or a Jurkat cell. In some embodiments, the reduced level is at least 5%, 10%, 20%, 30%, 40%, 50%, 60%, 70%, 80%, 90%, 95%, 98%, or 99% compared to the reference cell. In some embodiments, the immune activating agent is substantially absent from the fusosome.

In some embodiments, the fusosome composition comprises a membrane with composition substantially similar, e.g., as measured by proteomics, to that of a source cell, e.g., a substantially non-immunogenic source cell. In some embodiments, the fusosome composition comprises a membrane comprising at least 1%, 2%, 3%, 4%, 5%, 10%, 20%, 30%, 40%, 50%, 60%, 70%, 80%, 90%, 95%, 99%, or 100% of the membrane proteins of the source cell. In some embodiments, the fusosome composition comprises a membrane comprising membrane proteins expressed at, at least 1%, 2%, 3%, 4%, 5%, 10%, 20%, 30%, 40%, 50%, 60%, 70%, 80%, 90%, 95%, 99%, or 100% of the level of expression of the membrane proteins on a membrane of the source cell.

In some embodiments, the fusosome composition, or the source cell from which the fusosome composition is derived from, has one, two, three, four, five, six, seven, eight, nine, ten, eleven, twelve, or more of the following characteristics:

a. less than 50%, 40%, 30%, 20%, 15%, 10%, or 5% or lesser expression of MHC class I or MHC class II, compared to a reference cell, e.g., an unmodified cell otherwise similar to the source cell, or a HeLa cell;

b. less than 50%, 40%, 30%, 20%, 15%, 10%, or 5% or lesser expression of one or more co-stimulatory proteins including but not limited to: LAG3, ICOS-L, ICOS, Ox40L, OX40, CD28, B7, CD30, CD30L4-1BB, 4-1BBL, SLAM, CD27, CD70, HVEM, LIGHT, B7-H3, or B7-H4, compared to a reference cell, e.g., an unmodified cell otherwise similar to the source cell, or a reference cell described herein;

c. expression of surface proteins which suppress macrophage engulfment e.g., CD47, e.g., detectable expression by a method described herein, e.g., more than 1.5-fold, 2-fold, 3-fold, 4-fold, 5-fold, 10-fold, or more expression of the surface protein which suppresses macrophage engulfment, e.g., CD47, compared to a reference cell, e.g., an unmodified cell otherwise similar to the source cell, or a Jurkat cell;

d. expression of soluble immunosuppressive cytokines, e.g., IL-10, e.g., detectable expression by a method described herein, e.g., more than 1.5-fold, 2-fold, 3-fold, 4-fold, 5-fold, 10-fold, or more expression of soluble immunosuppressive cytokines, e.g., IL-10, compared to a reference cell, e.g., an unmodified cell otherwise similar to the source cell, or a Jurkat cell;

e. expression of soluble immunosuppressive proteins, e.g., PD-L1, e.g., detectable expression by a method described herein, e.g., more than 1.5-fold, 2-fold, 3-fold, 4-fold, 5-fold, 10-fold, or more expression of soluble immunosuppressive proteins, e.g., PD-L1, compared to a reference cell e.g., an unmodified cell otherwise similar to the source cell, or a Jurkat cell;
f. less than 50%, 40%, 30%, 20%, 15%, 10%, or 5% or lesser expression of soluble immune stimulating cytokines, e.g., IFN-gamma or TNF-α, compared to a reference cell, e.g., an unmodified cell otherwise similar to the source cell, or a U-266 cell;
g. less than 50%, 40%, 30%, 20%, 15%, 10%, or 5% or lesser expression of endogenous immune-stimulatory antigen, e.g., Zg16 or Hormad1, compared to a reference cell, e.g., an unmodified cell otherwise similar to the source cell, or an A549 cell or a SK-BR-3 cell;
h. expression of, e.g., detectable expression by a method described herein, HLA-E or HLA-G, compared to a reference cell, e.g., an unmodified cell otherwise similar to the source cell, or a Jurkat cell;
i. surface glycosylation profile, e.g., containing sialic acid, which acts to, e.g., suppress NK cell activation;
j. less than 50%, 40%, 30%, 20%, 15%, 10%, or 5% or lesser expression of TCRα/β, compared to a reference cell, e.g., an unmodified cell otherwise similar to the source cell, or a Jurkat cell;
k. less than 50%, 40%, 30%, 20%, 15%, 10%, or 5% or lesser expression of ABO blood groups, compared to a reference cell, e.g., an unmodified cell otherwise similar to the source cell, or a HeLa cell;
l. less than 50%, 40%, 30%, 20%, 15%, 10%, or 5% or lesser expression of Minor Histocompatibility Antigen (MHA), compared to a reference cell, e.g., an unmodified cell otherwise similar to the source cell, or a Jurkat cell; or
m. has less than 10%, 9%, 8%, 7%, 6%, 5%, 4%, 3%, 2%, 1%, or less, of mitochondrial MHAs, compared to a reference cell e.g., an unmodified cell otherwise similar to the source cell, or a Jurkat cell, or has no detectable mitochondrial MHAs.

In embodiments, the co-stimulatory protein is 4-1BB, B7, SLAM, LAG3, HVEM, or LIGHT, and the ref cell is HDLM-2. In some embodiments, the co-stimulatory protein is BY-H3 and the reference cell is HeLa. In some embodiments, the co-stimulatory protein is ICOSL or B7-H4, and the reference cell is SK-BR-3. In some embodiments, the co-stimulatory protein is ICOS or OX40, and the reference cell is MOLT-4. In some embodiments, the co-stimulatory protein is CD28, and the reference cell is U-266. In some embodiments, the co-stimulatory protein is CD30L or CD27, and the reference cell is Daudi.

In some embodiments, the fusosome composition does not substantially elicit an immunogenic response by the immune system, e.g., innate immune system. In embodiments, an immunogenic response can be quantified, e.g., as described herein. In some embodiments, the an immunogenic response by the innate immune system comprises a response by innate immune cells including, but not limited to NK cells, macrophages, neutrophils, basophils, eosinophils, dendritic cells, mast cells, or gamma/delta T cells. In some embodiments, an immunogenic response by the innate immune system comprises a response by the complement system which includes soluble blood components and membrane bound components.

In some embodiments, the fusosome composition does not substantially elicit an immunogenic response by the immune system, e.g., adaptive immune system. In embodiments, an immunogenic response can be quantified, e.g., as described herein. In some embodiments, an immunogenic response by the adaptive immune system comprises an immunogenic response by an adaptive immune cell including, but not limited to a change, e.g., increase, in number or activity of T lymphocytes (e.g., CD4 T cells, CD8 T cells, and or gamma-delta T cells), or B lymphocytes. In some embodiments, an immunogenic response by the adaptive immune system includes increased levels of soluble blood components including, but not limited to a change, e.g., increase, in number or activity of cytokines or antibodies (e.g., IgG, IgM, IgE, IgA, or IgD).

In some embodiments, the fusosome composition is modified to have reduced immunogenicity. Immunogenicity can be quantified, e.g., as described herein. In some embodiments, the fusosome composition has an immunogenicity less than 5%, 10%, 20%, 30%, 40%, or 50% lesser than the immunogenicity of a reference cell, e.g., an unmodified cell otherwise similar to the source cell, or a Jurkat cell.

In some embodiments of any of the aspects described herein, the fusosome composition is derived from a source cell, e.g., a mammalian cell, having a modified genome, e.g., modified using a method described herein, to reduce, e.g., lessen, immunogenicity. Immunogenicity can be quantified, e.g., as described herein.

In some embodiments, the fusosome composition is derived from a mammalian cell depleted of, e.g., with a knock out of, one, two, three, four, five, six, seven or more of the following:
a. MHC class I, MHC class II or MHA;
b. one or more co-stimulatory proteins including but not limited to: LAG3, ICOS-L, ICOS, Ox40L, OX40, CD28, B7, CD30, CD30L4-1BB, 4-1BBL, SLAM, CD27, CD70, HVEM, LIGHT, B7-H3, or B7-H4;
c. soluble immune-stimulating cytokines e.g., IFN-gamma or TNF-α;
d. endogenous immune-stimulatory antigen, e.g., Zg16 or Hormad1;
e. T-cell receptors (TCR);
f. The genes encoding ABO blood groups, e.g., ABO gene;
g. transcription factors which drive immune activation, e.g., NFkB;
h. transcription factors that control MHC expression e.g., class II trans-activator (CIITA), regulatory factor of the Xbox 5 (RFX5), RFX-associated protein (RFXAP), or RFX ankyrin repeats (RFXANK; also known as RFXB); or
i. TAP proteins, e.g., TAP2, TAP1, or TAPBP, which reduce MHC class I expression.

In some embodiments, the fusosome is derived from a source cell with a genetic modification which results in increased expression of an immunosuppressive agent, e.g., one, two, three or more of the following (e.g., wherein before the genetic modification the cell did not express the factor):
a. surface proteins which suppress macrophage engulfment, e.g., CD47; e.g., increased expression of CD47 compared to a reference cell, e.g., an unmodified cell otherwise similar to the source cell, or a Jurkat cell;
b. soluble immunosuppressive cytokines, e.g., IL-10, e.g., increased expression of IL-10 compared to a reference cell, e.g., an unmodified cell otherwise similar to the source cell, or a Jurkat cell;
c. soluble immunosuppressive proteins, e.g., PD-1, PD-L1, CTLA4, or BTLA; e.g., increased expression of immunosuppressive proteins compared to a reference cell, e.g., an unmodified cell otherwise similar to the cell source, or a Jurkat cell; or d. a tolerogenic protein, e.g., an ILT-2 or ILT-4 agonist, e.g., HLA-E or HLA-G or any other endogenous ILT-2 or ILT-4 agonist, e.g., increased expression of HLA-E, HLA-G, ILT-2 or ILT-4 compared to a reference cell, e.g., an unmodified cell otherwise similar to the source cell, or a Jurkat cell.

In some embodiments, the increased expression level is at least 5%, 10%, 20%, 30%, 40%, 50%, 60%, 70%, 80%, 90%, 2-fold, 3-fold, 5-fold, 10-fold, 20-fold, 50-fold, or 100-fold higher as compared to a reference cell.

In some embodiments, the fusosome is derived from a source cell modified to have decreased expression of an immune activating agent, e.g., one, two, three, four, five, six, seven, eight or more of the following:

a. less than 50%, 40%, 30%, 20%, 15%, 10%, or 5% or lesser expression of MHC class I or MHC class II, compared to a reference cell, e.g., an unmodified cell otherwise similar to the source cell, or a HeLa cell;

b. less than 50%, 40%, 30%, 20%, 15%, 10%, or 5% or lesser expression of one or more co-stimulatory proteins including but not limited to: LAG3, ICOS-L, ICOS, Ox40L, OX40, CD28, B7, CD30, CD30L 4-1BB, 4-1BBL, SLAM, CD27, CD70, HVEM, LIGHT, B7-H3, or B7-H4, compared to a reference cell, e.g., an unmodified cell otherwise similar to the source cell, or a reference cell described herein;

c. less than 50%, 40%, 30%, 20%, 15%, 10%, or 5% or lesser expression of soluble immune stimulating cytokines, e.g., IFN-gamma or TNF-α, compared to a reference cell, e.g., an unmodified cell otherwise similar to the source cell, or a U-266 cell;

d. less than 50%, 40%, 30%, 20%, 15%, 10%, or 5% or lesser expression of endogenous immune-stimulatory antigen, e.g., Zg16 or Hormad1, compared to a reference cell, e.g., an unmodified cell otherwise similar to the source cell, or an A549 cell or a SK-BR-3 cell;

e. less than 50%, 40%, 30%, 20%, 15%, 10%, or 5% or lesser expression of T-cell receptors (TCR) compared to a reference cell, e.g., an unmodified cell otherwise similar to the source cell, or a Jurkat cell;

f. less than 50%, 40%, 30%, 20%, 15%, 10%, or 5% or lesser expression of ABO blood groups, compared to a reference cell, e.g., an unmodified cell otherwise similar to the source cell, or a HeLa cell;

g. less than 50%, 40%, 30%, 20%, 15%, 10%, or 5% or lesser expression of transcription factors which drive immune activation, e.g., NFkB; compared to a reference cell, e.g., an unmodified cell otherwise similar to the source cell, or a Jurkat cell h. less than 50%, 40%, 30%, 20%, 15%, 10%, or 5% or lesser expression of transcription factors that control MHC expression, e.g., class II trans-activator (CIITA), regulatory factor of the Xbox 5 (RFX5), RFX-associated protein (RFXAP), or RFX ankyrin repeats (RFXANK; also known as RFXB) compared to a reference cell, e.g., an unmodified cell otherwise similar to the source cell, or a Jurkat cell; or i. less than 50%, 40%, 30%, 20%, 15%, 10%, or 5% or lesser expression of TAP proteins, e.g., TAP2, TAP1, or TAPBP, which reduce MHC class I expression compared to a reference cell, e.g., an unmodified cell otherwise similar to the source cell, or a HeLa cell.

In some embodiments, a fusosome composition derived from a mammalian cell, e.g., a mesenchymal stem cell, modified using shRNA expressing lentivirus to decrease MHC Class I expression, has lesser expression of MHC Class I compared to an unmodified cell, e.g., a mesenchymal stem cell that has not been modified. In some embodiments, a fusosome composition derived from a mammalian cell, e.g., a mesenchymal stem cell, modified using lentivirus expressing HLA-G to increase expression of HLA-G, has increased expression of HLA-G compared to an unmodified cell, e.g., a mesenchymal stem cell that has not been modified.

In some embodiments, the fusosome composition is derived from a source cell, e.g., a mammalian cell, which is not substantially immunogenic, wherein the source cells stimulate, e.g., induce, T-cell IFN-gamma secretion, at a level of 0 pg/mL to >0 pg/mL, e.g., as assayed in vitro, by IFN-gamma ELISPOT assay.

In some embodiments, the fusosome composition is derived from a source cell, e.g., a mammalian cell, wherein the mammalian cell is from a cell culture treated with an immunosuppressive agent, e.g., a glucocorticoid (e.g., dexamethasone), cytostatic (e.g., methotrexate), antibody (e.g., Muromonab-CD3), or immunophilin modulator (e.g., Ciclosporin or rapamycin).

In some embodiments, the fusosome composition is derived from a source cell, e.g., a mammalian cell, wherein the mammalian cell comprises an exogenous agent, e.g., a therapeutic agent.

In some embodiments, the fusosome composition is derived from a source cell, e.g., a mammalian cell, wherein the mammalian cell is a recombinant cell.

In some embodiments, the fusosome is derived from a mammalian cell genetically modified to express viral immunoevasins, e.g., hCMV US2, or US11.

In some embodiments, the surface of the fusosome, or the surface of the mammalian cell the fusosome is derived from, is covalently or non-covalently modified with a polymer, e.g., a biocompatible polymer that reduces immunogenicity and immune-mediated clearance, e.g., PEG.

In some embodiments, the surface of the fusosome, or the surface of the mammalian cell the fusosome is derived from is covalently or non-covalently modified with a sialic acid, e.g., a sialic acid comprising glycopolymers, which contain NK-suppressive glycan epitopes.

In some embodiments, the surface of the fusosome, or the surface of the mammalian cell the fusosome is derived from is enzymatically treated, e.g., with glycosidase enzymes, e.g., α-N-acetylgalactosaminidases, to remove ABO blood groups In some embodiments, the surface of the fusosome, or the surface of the mammalian cell the fusosome is derived from is enzymatically treated, to give rise to, e.g., induce expression of, ABO blood groups which match the recipient's blood type.

Parameters for Assessing Immunogenicity

In some embodiments, the fusosome composition is derived from a source cell, e.g., a mammalian cell which is not substantially immunogenic, or modified, e.g., modified using a method described herein, to have a reduction in immunogenicity. Immunogenicity of the source cell and the fusosome composition can be determined by any of the assays described herein.

In some embodiments, the fusosome composition has an increase, e.g., an increase of 1%, 5%, 10%, 20%, 30%, 40%, 50%, 60%, 70%, 80%, 90%, or more, in in vivo graft survival compared to a reference cell, e.g., an unmodified cell otherwise similar to the source cell. In some embodiments, graft survival is determined by an assay measuring in vivo graft survival as described herein, in an appropriate animal model, e.g., an animal model described herein.

In some embodiments, the fusosome composition has an increase, e.g., an increase of 1%, 5%, 10%, 20%, 30%, 40%, 50%, 60%, 70%, 80%, 90%, or more in teratoma formation compared to a reference cell, e.g., an unmodified cell otherwise similar to the source cell. In some embodiments, teratroma formation is determined by an assay measuring teratoma formation as described herein, in an appropriate animal model, e.g., in an animal model described herein.

In some embodiments, the fusosome composition has an increase, e.g., an increase of 1%, 5%, 10%, 20%, 30%, 40%, 50%, 60%, 70%, 80%, 90%, or more in teratoma survival compared to a reference cell, e.g., an unmodified cell otherwise similar to the source cell. In some embodiments, the fusosome composition survives for one or more days in an assay of teratoma survival. In some embodiments, teratroma survival is determined by an assay measuring teratoma survival as described herein, in an appropriate animal model, e.g., in an animal model described herein. In an embodiments, teratoma formation is measured by imaging analysis, e.g., IHC staining, fluorescent staining or H&E, of fixed tissue, e.g., frozen or formalin fixed, as described in the Examples. In some embodiments, fixed tissue can be stained with any one or all of the following antibodies: anti-human CD3, anti-human CD4, or anti-human CD8.

In some embodiments, the fusosome composition has a reduction, e.g., a reduction of 1%, 5%, 10%, 20%, 30%, 40%, 50%, 60%, 70%, 80%, 90%, or more in CD8+ T cell infiltration into a graft or teratoma compared to a reference cell, e.g., an unmodified cell otherwise similar to the source cell. In some embodiments, CD8 T cell infiltration is determined by an assay measuring CD8+ T cell infiltration as described herein, e.g., histological analysis, in an appropriate animal model, e.g., an animal model described herein. In some embodiments, teratomas derived from the fusosome composition have CD8+ T cell infiltration in 0%, 0.1%, 1% 5%, 10%, 20%, 30%, 40% 50%, 60%, 70%, 80%, 90%, or 100% of 50× image fields of a histology tissue section.

In some embodiments, a fusosome composition has a reduction, e.g., a reduction of 1%, 5%, 10%, 20%, 30%, 40%, 50%, 60%, 70%, 80%, 90%, or more in CD4+ T cell infiltration into a graft or teratoma compared to a reference cell, e.g., an unmodified cell otherwise similar to the source cell. In some embodiments, CD4 T cell infiltration is determined by an assay measuring CD4+ T cell infiltration as described herein, e.g., histological analysis, in an appropriate animal model, e.g., an animal model described herein. In some embodiments, teratomas derived from the fusosome composition have CD4+ T cell infiltration in 0%, 0.1%, 1% 5%, 10%, 20%, 30%, 40% 50%, 60%, 70%, 80%, 90%, or 100% of 50× image fields of a histology tissue section.

In some embodiments, a fusosome composition has a reduction, e.g., a reduction of 1%, 5%, 10%, 20%, 30%, 40%, 50%, 60%, 70%, 80%, 90%, or more in CD3+ NK cell infiltration into a graft or teratoma compared to a reference cell, e.g., an unmodified cell otherwise similar to the source cell. In some embodiments, CD3+ NK cell infiltration is determined by an assay measuring CD3+ NK cell infiltration as described herein, e.g., histological analysis, in an appropriate animal model, e.g., an animal model described herein. In some embodiments, teratomas derived from the fusosome composition have CD3+ NK T cell infiltration in 0%, 0.1%, 1% 5%, 10%, 20%, 30%, 40% 50%, 60%, 70%, 80%, 90%, or 100% of 50× image fields of a histology tissue section.

In some embodiments, the fusosome composition has a reduction in immunogenicity as measured by a reduction in humoral response following one or more implantation of the fusosome derived into an appropriate animal model, e.g., an animal model described herein, compared to a humoral response following one or more implantation of a reference cell, e.g., an unmodified cell otherwise similar to the source cell, into an appropriate animal model, e.g., an animal model described herein. In some embodiments, the reduction in humoral response is measured in a serum sample by an anti-cell antibody titre, e.g., anti-fusosome antibody titre, e.g., by ELISA. In some embodiments, the serum sample from animals administered the fusosome composition has a reduction of 1%, 5%, 10%, 20%, 30%, 40%, 50%, 60%, 70%, 80%, 90%, or more of an anti-cell antibody titer compared to the serum sample from animals administered an unmodified cell. In some embodiments, the serum sample from animals administered the fusosome composition has an increased anti-cell antibody titre, e.g., increased by 1%, 2%, 5%, 10%, 20%, 30%, or. 40% from baseline, e.g., wherein baseline refers to serum sample from the same animals before administration of the fusosome composition.

In some embodiments, the fusosome composition has a reduction in macrophage phagocytosis, e.g., a reduction of 1%, 5%, 10%, 20%, 30%, 40%, 50%, 60%, 70%, 80%, 90%, or more in macrophage phagocytosis compared to a reference cell, e.g., an unmodified cell otherwise similar to the source cell, wherein the reduction in macrophage phagocytosis is determined by assaying the phagocytosis index in vitro, e.g., as described in Example 82. In some embodiments, the fusosome composition has a phagocytosis index of 0, 1, 10, 100, or more, e.g., as measured by an assay of Example 82, when incubated with macrophages in an in vitro assay of macrophage phagocytosis.

In some embodiments, the source cell has a reduction in cytotoxicity mediated cell lysis by PBMCs, e.g., a reduction of 1%, 5%, 10%, 20%, 30%, 40%, 50%, 60%, 70%, 80%, 90%, or more in cell lysis compared to a reference cell, e.g., an unmodified cell otherwise similar to the source cell or a mesenchymal stem cells, e.g., using an assay of Example 83. In embodiments, the source cell expresses exogenous HLA-G.

In some embodiments, the fusosome composition has a reduction in NK-mediated cell lysis, e.g., a reduction of 1%, 5%, 10%, 20%, 30%, 40%, 50%, 60%, 70%, 80%, 90%, or more in NK-mediated cell lysis compared to a reference cell, e.g., an unmodified cell otherwise similar to the source cell, wherein NK-mediated cell lysis is assayed in vitro, by a chromium release assay or europium release assay.

In some embodiments, the fusosome composition has a reduction in CD8+ T-cell mediated cell lysis, e.g., a reduction of 1%, 5%, 10%, 20%, 30%, 40%, 50%, 60%, 70%, 80%, 90%, or more in CD8 T cell mediated cell lysis compared to a reference cell, e.g., an unmodified cell otherwise similar to the source cell, wherein CD8 T cell mediated cell lysis is assayed in vitro, by a chromium release assay or europium release assay. In embodiments, activation and/or proliferation is measured as described in Example 85.

In some embodiments, the fusosome composition has a reduction in CD4+ T-cell proliferation and/or activation, e.g., a reduction of 1%, 5%, 10%, 20%, 30%, 40%, 50%, 60%, 70%, 80%, 90%, or more compared to a reference cell, e.g., an unmodified cell otherwise similar to the source cell, wherein CD4 T cell proliferation is assayed in vitro (e.g. co-culture assay of modified or unmodified mammalian source cell, and CD4+ T-cells with CD3/CD28 Dynabeads), e.g., as described in Example 86.

In some embodiments, the fusosome composition has a reduction in T-cell IFN-gamma secretion, e.g., a reduction of 1%, 5%, 10%, 20%, 30%, 40%, 50%, 60%, 70%, 80%, 90%, or more in T-cell IFN-gamma secretion compared to a reference cell, e.g., an unmodified cell otherwise similar to the source cell, wherein T-cell IFN-gamma secretion is assayed in vitro, e.g., by IFN-gamma ELISPOT.

In some embodiments, the fusosome composition has a reduction in secretion of immunogenic cytokines, e.g., a reduction of 1%, 5%, 10%, 20%, 30%, 40%, 50%, 60%, 70%, 80%, 90%, or more in secretion of immunogenic cytokines compared to a reference cell, e.g., an unmodified cell otherwise similar to the source cell, wherein secretion of immunogenic cytokines is assayed in vitro using ELISA or ELISPOT.

In some embodiments, the fusosome composition results in increased secretion of an immunosuppressive cytokine, e.g., an increase of 1%, 5%, 10%, 20%, 30%, 40%, 50%, 60%, 70%, 80%, 90%, or more in secretion of an immunosuppressive cytokine compared to a reference cell, e.g., an unmodified cell otherwise similar to the source cell, wherein secretion of the immunosuppressive cytokine is assayed in vitro using ELISA or ELISPOT.

In some embodiments, the fusosome composition has an increase in expression of HLA-G or HLA-E, e.g., an increase in expression of 1%, 5%, 10%, 20%, 30%, 40%, 50%, 60%, 70%, 80%, 90%, or more of HLA-G or HLA-E, compared to a reference cell, e.g., an unmodified cell otherwise similar to the source cell, wherein expression of HLA-G or HLA-E is assayed in vitro using flow cytometry, e.g., FACS. In some embodiments, the fusosome composition is derived from a source cell which is modified to have an increased expression of HLA-G or HLA-E, e.g., compared to an unmodified cell, e.g., an increased expression of 1%, 5%, 10%, 20%, 30%, 40%, 50%, 60%, 70%, 80%, 90%, or more of HLA-G or HLA-E, wherein expression of HLA-G or HLA-E is assayed in vitro using flow cytometry, e.g., FACS. In some embodiments, the fusosome composition derived from a modified cell with increased HLA-G expression demonstrates reduced immunogenicity, e.g., as measured by reduced immune cell infiltration, in a teratoma formation assay, e.g., a teratoma formation assay as described herein.

In some embodiments, the fusosome composition has an increase in expression of T cell inhibitor ligands (e.g. CTLA4, PD1, PD-L1), e.g., an increase in expression of 1%, 5%, 10%, 20%, 30%, 40%, 50%, 60%, 70%, 80%, 90%, or more of T cell inhibitor ligands as compared to a reference cell, e.g., an unmodified cell otherwise similar to the source cell, wherein expression of T cell inhibitor ligands is assayed in vitro using flow cytometry, e.g., FACS.

In some embodiments, the fusosome composition has a decrease in expression of co-stimulatory ligands, e.g., a decrease of 1%, 5%, 10%, 20%, 30%, 40%, 50%, 60%, 70%, 80%, 90%, or more in expression of co-stimulatory ligands compared to a reference cell, e.g., an unmodified cell otherwise similar to the source cell, wherein expression of co-stimulatory ligands is assayed in vitro using flow cytometry, e.g., FACS.

In some embodiments, the fusosome composition has a decrease in expression of MHC class I or MHC class II, e.g., a decrease in expression of 1%, 5%, 10%, 20%, 30%, 40%, 50%, 60%, 70%, 80%, 90%, or more of MHC Class I or MHC Class II compared to a reference cell, e.g., an unmodified cell otherwise similar to the source cell or a HeLa cell, wherein expression of MHC Class I or II is assayed in vitro using flow cytometry, e.g., FACS.

In some embodiments, the fusosome composition is derived from a cell source, e.g., a mammalian cell source, which is substantially non-immunogenic. In some embodiments, immunogenicity can be quantified, e.g., as described herein. In some embodiments, the mammalian cell source comprises any one, all or a combination of the following features:

a. wherein the source cell is obtained from an autologous cell source; e.g., a cell obtained from a recipient who will be receiving, e.g., administered, the fusosome composition;
b. wherein the source cell is obtained from an allogeneic cell source which is of matched, e.g., similar, gender to a recipient, e.g., a recipient described herein who will be receiving, e.g., administered; the fusosome composition;
c. wherein the source cell is obtained is from an allogeneic cell source is which is HLA matched with a recipient's HLA, e.g., at one or more alleles;
d. wherein the source cell is obtained is from an allogeneic cell source which is an HLA homozygote;
e. wherein the source cell is obtained is from an allogeneic cell source which lacks (or has reduced levels compared to a reference cell) MHC class I and II; or
f. wherein the source cell is obtained is from a cell source which is known to be substantially non-immunogenic including but not limited to a stem cell, a mesenchymal stem cell, an induced pluripotent stem cell, an embryonic stem cell, a sertoli cell, or a retinal pigment epithelial cell.

In some embodiments, the subject to be administered the fusosome composition has, or is known to have, or is tested for, a pre-existing antibody (e.g., IgG or IgM) reactive with a fusosome. In some embodiments, the subject to be administered the fusosome composition does not have detectable levels of a pre-existing antibody reactive with the fusosome. Tests for the antibody are described, e.g., in Example 78.

In some embodiments, a subject that has received the fusosome composition has, or is known to have, or is tested for, an antibody (e.g., IgG or IgM) reactive with a fusosome. In some embodiments, the subject that received the fusosome composition (e.g., at least once, twice, three times, four times, five times, or more) does not have detectable levels of antibody reactive with the fusosome. In embodiments, levels of antibody do not rise more than 1%, 2%, 5%, 10%, 20%, or 50% between two timepoints, the first timepoint being before the first administration of the fusosome, and the second timepoint being after one or more administrations of the fusosome. Tests for the antibody are described, e.g., in Example 79.

Additional Therapeutic Agents

In some embodiments, the fusosome composition is co-administered with an additional agent, e.g., a therapeutic agent, to a subject, e.g., a recipient, e.g., a recipient described herein. In some embodiments, the co-administered therapeutic agent is an immunosuppressive agent, e.g., a glucocorticoid (e.g., dexamethasone), cytostatic (e.g., methotrexate), antibody (e.g., Muromonab-CD3), or immunophilin modulator (e.g., Ciclosporin or rapamycin). In embodiments, the immunosuppressive agent decreases immune mediated clearance of fusosomes. In some embodiments the fusosome composition is co-administered with an immunostimulatory agent, e.g., an adjuvant, an interleukin, a cytokine, or a chemokine.

In some embodiments, the fusosome composition and the immunosuppressive agent are administered at the same time, e.g., contemporaneously administered. In some embodiments, the fusosome composition is administered before administration of the immunosuppressive agent. In some embodiments, the fusosome composition is administered after administration of the immunosuppressive agent.

In some embodiments, the immunosuppressive agent is a small molecule such as ibuprofen, acetaminophen, cyclosporine, tacrolimus, rapamycin, mycophenolate, cyclophosphamide, glucocorticoids, sirolimus, azathriopine, or methotrexate.

In some embodiments, the immunosuppressive agent is an antibody molecule, including but not limited to: muronomab (anti-CD3), Daclizumab (anti-IL12), Basiliximab, Infliximab (Anti-TNFa), or rituximab (Anti-CD20).

In some embodiments, co-administration of the fusosome composition with the immunosuppressive agent results in enhanced persistence of the fusosome composition in the subject compared to administration of the fusosome composition alone. In some embodiments, the enhanced persistence of the fusosome composition in the co-administration is at least 10%, 20%, 30%, 40%, 50%, 60%, 70%, 80%, 90% or longer, compared to persistence of the fusosome composition when administered alone. In some embodiments, the enhanced persistence of the fusosome composition in the co-administration is at least 1, 2, 3, 4, 5, 6, 7, 10, 15, 20, 25, or 30 days or longer, compared to survival of the fusosome composition when administered alone.

Delivery

In some embodiments, a fusogen (e.g., protein, lipid, or chemical fusogen) or a fusogen binding partner is delivered to a target cell or tissue prior to, at the same time, or after the delivery of a fusosome.

In some embodiments, a fusogen (e.g., protein, lipid, or chemical fusogen) or a fusogen binding partner is delivered to a non-target cell or tissue prior to, at the same time, or after the delivery of a fusosome.

In some embodiments, a nucleic acid that encodes a fusogen (e.g., protein or lipid fusogen) or a fusogen binding partner is delivered to a target cell or tissue prior to, at the same time, or after the delivery of a fusosome.

In some embodiments, a polypeptide, nucleic acid, ribonucleoprotein, or small-molecule that upregulates or downregulates expression of a fusogen (e.g., protein, lipid, or chemical fusogen) or a fusogen binding partner is delivered to a target cell or tissue prior to, at the same time, or after the delivery of a fusosome.

In some embodiments, a polypeptide, nucleic acid, ribonucleoprotein, or small-molecule that upregulates or downregulates expression of a fusogen (e.g., protein, lipid, or chemical fusogen) or a fusogen binding partner is delivered to a non-target cell or tissue prior to, at the same time, or after the delivery of a fusosome.

In some embodiments, the target cell or tissue is modified by (e.g., inducing stress or cell division) to increase the rate of fusion prior to, at the same time, or after the delivery of a fusosome. Some nonlimiting examples include, inducing ischemia, treatment with chemotherapy, antibiotic, irradiation, toxin, inflammation, inflammatory molecules, anti-inflammatory molecules, acid injury, basic injury, burn, polyethylene glycol, neurotransmitters, myelotoxic drugs, growth factors, or hormones, tissue resection, starvation, and/or exercise.

In some embodiments, the target cell or tissue is treated with a vasodilator (e.g. nitric oxide (NO), carbon monoxide, prostacyclin (PGI2), nitroglycerine, phentolamine) or vasoconstrictors (e.g. angiotensin (AGT), endothelin (EDN), norepinephrine)) to increase the rate of fusosome transport to the target tissue.

In some embodiments, the target cell or tissue is treated with a chemical agent, e.g., a chemotherapeutic. In such embodiments, the chemotherapeutic induces damage to the target cell or tissue that enhances fusogenic activity of target cells or tissue.

In some embodiments, the target cell or tissue is treated with a physical stress, e.g., electrofusion. In such embodiments, the physical stress destabilizes the membranes of the target cell or tissue to enhance fusogenic activity of target cells or tissue.

In some embodiments, the target cell or tissue may be treated with an agent to enhance fusion with a fusosome. For example, specific neuronal receptors may be stimulated with an anti-depressant to enhance fusogenic properties.

Compositions comprising the fusosomes described herein may be administered or targeted to the circulatory system, hepatic system, renal system, cardio-pulmonary system, central nervous system, peripheral nervous system, musculoskeletal system, lymphatic system, immune system, sensory nervous systems (sight, hearing, smell, touch, taste), digestive system, endocrine systems (including adipose tissue metabolic regulation), and reproductive system.

In embodiments, a fusosome composition described herein is delivered ex-vivo to a cell or tissue, e.g., a human cell or tissue. In some embodiments, the composition is delivered to an ex vivo tissue that is in an injured state (e.g., from trauma, disease, hypoxia, ischemia or other damage).

In some embodiments, the fusosome composition is delivered to an ex-vivo transplant (e.g., a tissue explant or tissue for transplantation, e.g., a human vein, a musculoskeletal graft such as bone or tendon, cornea, skin, heart valves, nerves; or an isolated or cultured organ, e.g., an organ to be transplanted into a human, e.g., a human heart, liver, lung, kidney, pancreas, intestine, thymus, eye). The composition improves viability, respiration, or other function of the transplant. The composition can be delivered to the tissue or organ before, during and/or after transplantation.

In some embodiments, a fusosome composition described herein is delivered ex-vivo to a cell or tissue derived from a subject. In some embodiments the cell or tissue is readministered to the subject (i.e., the cell or tissue is autologous).

The fusosomes may fuse with a cell from any mammalian (e.g., human) tissue, e.g., from epithelial, connective, muscular, or nervous tissue or cells, and combinations thereof. The fusosomes can be delivered to any eukaryotic (e.g., mammalian) organ system, for example, from the cardiovascular system (heart, vasculature); digestive system (esophagus, stomach, liver, gallbladder, pancreas, intestines, colon, rectum and anus); endocrine system (hypothalamus, pituitary gland, pineal body or pineal gland, thyroid, parathyroids, adrenal glands); excretory system (kidneys, ureters, bladder); lymphatic system (lymph, lymph nodes, lymph vessels, tonsils, adenoids, thymus, spleen); integumentary system (skin, hair, nails); muscular system (e.g., skeletal muscle); nervous system (brain, spinal cord, nerves) '; reproductive system (ovaries, uterus, mammary glands, testes, vas deferens, seminal vesicles, prostate); respiratory system (pharynx, larynx, trachea, bronchi, lungs, diaphragm); skeletal system (bone, cartilage), and combinations thereof.

In embodiments, the fusosome targets a tissue, e.g., liver, lungs, heart, spleen, pancreas, gastrointestinal tract, kidney, testes, ovaries, brain, reproductive organs, central nervous system, peripheral nervous system, skeletal muscle, endothelium, inner ear, adipose tissue (e.g., brown adipose tissue or white adipose tissue) or eye, when administered to a subject, e.g., wherein at least 0.1%, 0.5%, 1%, 1.5%, 2%, 2.5%, 3%, 4%, 5%, 10%, 20%, 30%, 40%, 50%, 60%, 70%, 80%, or 90% of the fusosomes in a population of administered fusosomes are present in the target tissue after 24, 48, or 72 hours, e.g., by an assay of Example 87 or 100.

In embodiments, the fusosomes may fuse with a cell from a source of stem cells or progenitor cells, e.g., bone marrow stromal cells, marrow-derived adult progenitor cells (MAPCs), endothelial progenitor cells (EPC), blast cells, intermediate progenitor cells formed in the subventricular zone, neural stem cells, muscle stem cells, satellite cells, liver stem cells, hematopoietic stem cells, bone marrow stromal cells, epidermal stem cells, embryonic stem cells, mesenchymal stem cells, umbilical cord stem cells, precursor cells, muscle precursor cells, myoblast, cardiomyoblast, neural precursor cells, glial precursor cells, neuronal precursor cells, hepatoblasts.

Fusogen Binding Partners, e.g., for Landing Pad Embodiments

In certain aspects, the disclosure provides a method of delivering a fusosome to a target cell in a subject. In some embodiments, the method comprises administering to a subject a fusosome comprising a nucleic acid encoding a fusogen, e.g., a myomaker protein, wherein the nucleic acid is not present or is not expressed (e.g., is present but is not transcribed or not translated) within a cell, under conditions that allow the fusogen to be expressed on the surface of the fusosome in the subject. In some embodiments, the method further comprises administering to the subject a composition comprising an agent, e.g., a therapeutic agent, and a fusogen binding partner, optionally, comprising a carrier, e.g., a membrane, under conditions that allow fusion of the fusogen on the fusosome, and the fusogen binding partner. In some embodiments, the carrier comprises a membrane, e.g., a lipid bilayer, e.g., the agent is disposed within a lipid bilayer. In some embodiments, the lipid bilayer fuses with the target cell, thereby delivering the agent to the target cell in the subject.

In some embodiments, a fusogen binding partner is a moiety, e.g., a protein molecule, disposed in a membrane (e.g., a lipid bilayer), of a target cell, e.g., a target cell disclosed herein. In some embodiments, the membrane can be a cell surface membrane, or a subcellular membrane of an organelle, e.g., a mitochondrion, lysosome, or Golgi apparatus. In some embodiments, a fusogen binding partner can be endogenously expressed, overexpressed, or exogenously expressed (e.g., by a method described herein). In some embodiments, the fusogen binding partner can cluster with other fusogen binding partners at the membrane.

In some embodiments, the presence of a fusogen binding partner, or a plurality of fusogen binding partners, in a membrane of a target cell, creates an interface that can facilitate the interaction, e.g., binding, between a fusogen binding partner on a target cell (e.g., a cell described herein), and a fusogen on a fusosome (e.g., a fusosome described herein). In some embodiments, the fusogen on a fusosome interacts with, e.g., binds to, a fusogen binding partner on target cell, e.g., on the membrane (e.g., lipid bilayer), of a target cell, to induce fusion of the fusosome with the target membrane. In some embodiments, the fusogen interacts with, e.g., binds to, a fusogen binding partner on a landing pad on a subcellular organelle, including a mitochondrion, to induce fusion of the fusosome with the subcellular organelle.

A fusogen binding partner can be introduced in a target cell, e.g., a target cell disclosed herein, by any of the methods discussed below.

In some embodiments, a method of introducing a fusogen binding partner to a target cell comprises removal, e.g., extraction, of a target cell (e.g., via apheresis or biopsy), from a subject (e.g., a subject described herein), and administration of, e.g., exposure to, a fusogen binding partner under conditions that allow the fusogen binding partner to be expressed on a membrane of the target cell. In some embodiments, a method comprises contacting the target cell expressing a fusogen binding partner ex vivo with a fusosome comprising a fusogen to induce fusion of the fusosome with the target cell membrane. In some embodiments, a target cell fused to the fusosome is reintroduced into the subject, e.g., intravenously.

In some embodiments, a target cell expressing a fusogen binding partner is reintroduced into the subject, e.g., intravenously. In some embodiments, a method comprises administering to the subject a fusosome comprising a fusogen to allow interaction, e.g., binding, of the fusogen on the fusosome with the fusogen binding partner on the target cell, and fusion of the fusosome with the target cell membrane.

In some embodiments, the target cells are treated with an epigenetic modifier, e.g., a small molecule epigenetic modifier, to increase or decrease expression of an endogenous cell surface molecule (e.g., in some embodiments, endogenous relative to the target cell), e.g., a fusogen binding partner, e.g., an organ, tissue, or cell targeting molecule, where the cell surface molecule is a protein, glycan, lipid or low molecular weight molecule. In some embodiments, a target cell is genetically modified to increase the expression of an endogenous cell surface molecule, e.g., a fusogen binding partner, e.g., an organ, tissue, or cell targeting molecule, where the cell surface molecule is a protein, glycan, lipid or low molecular weight molecule. In some embodiments, a genetic modification may decrease expression of a transcriptional activator of the endogenous cell surface molecule, e.g., a fusogen binding partner.

In some embodiments, a target cell is genetically modified to express, e.g., overexpress, an exogenous cell surface molecule, e.g., a fusogen binding partner, where the cell surface molecule is a protein, glycan, lipid or low molecular weight molecule.

In some embodiments, the target cell is genetically modified to increase the expression of an exogenous fusogen in the cell, e.g., delivery of a transgene. In some embodiments, a nucleic acid, e.g., DNA, mRNA or siRNA, is transferred to the target cell, e.g., to increase or decrease the expression of a cell surface molecule (protein, glycan, lipid or low molecular weight molecule). In some embodiments, the nucleic acid targets a repressor of a fusogen binding partner, e.g., an shRNA, or siRNA construct. In some embodiments, the nucleic acid encodes an inhibitor of a fusogen binding partner repressor.

METHODS OF USE

The administration of a pharmaceutical composition described herein may be by way of oral, inhaled, transdermal or parenteral (including intravenous, intratumoral, intraperitoneal, intramuscular, intracavity, and subcutaneous) administration. The fusosomes may be administered alone or formulated as a pharmaceutical composition.

The fusosomes may be administered in the form of a unit-dose composition, such as a unit dose oral, parenteral, transdermal or inhaled composition. Such compositions are prepared by admixture and are suitably adapted for oral, inhaled, transdermal or parenteral administration, and as such may be in the form of tablets, capsules, oral liquid preparations, powders, granules, lozenges, reconstitutable powders, injectable and infusable solutions or suspensions or suppositories or aerosols.

In some embodiments, delivery of a membrane protein payload agent via a fusosome composition described herein may induce or block cellular differentiation, de-differentiation, or trans-differentiation. The target mammalian cell may be a precursor cell. Alternatively, the target mammalian cell may be a differentiated cell, and the cell fate alteration includes driving de-differentiation into a pluripotent precursor cell, or blocking such de-differentiation. In situations where a change in cell fate is desired, effective amounts of a fusosome described herein encoding a cell fate inductive molecule or signal is introduced into a target cell under conditions such that an alteration in cell fate is induced. In some embodiments, a fusosome described herein is useful to reprogram a subpopulation of cells from a first phenotype to a second phenotype. Such a reprogramming may be temporary or permanent. Optionally, the reprogramming induces a target cell to adopt an intermediate phenotype.

Also provided are methods of reducing cellular differentiation in a target cell population. For example, a target cell population containing one or more precursor cell types is contacted with a fusosome composition described herein, under conditions such that the composition reduces the differentiation of the precursor cell. In certain embodiments, the target cell population contains injured tissue in a mammalian subject or tissue affected by a surgical procedure. The precursor cell is, e.g., a stromal precursor cell, a neural precursor cell, or a mesenchymal precursor cell.

A fusosome composition described herein, comprising a membrane protein payload agent may be used to deliver such agent to a cell tissue or subject. Delivery of a membrane protein payload agent by administration of a fusosome composition described herein may modify cellular protein expression levels. In certain embodiments, the administered directs upregulation of (via expression in the cell, delivery in the cell, or induction within the cell) of one or more membrane protein payload agent (e.g., a polypeptide or nucleic acid) that provide a functional activity which is substantially absent or reduced in the cell in which the membrane protein payload agent is delivered. For example, the missing functional activity may be enzymatic, structural, signaling or regulatory in nature. In related embodiments, the administered composition directs up-regulation of one or more membrane protein payload agent that increases (e.g., synergistically) a functional activity which is present but substantially deficient in the cell in which the membrane protein payload agent is upregulated. In related embodiments, the administered composition directs down-regulation of one or more polypeptides that decreases (e.g., synergistically) a functional activity which is present or upregulated in the cell in which the polypeptide is down-regulated. In certain embodiments, the administered composition directs upregulation of certain functional activities and downregulation of other functional activities.

In embodiments, the fusosome composition mediates an effect on a target cell, and the effect lasts for at least 1, 2, 3, 4, 5, 6, or 7 days, 2, 3, or 4 weeks, or 1, 2, 3, 6, or 12 months. In some embodiments (e.g., wherein the fusosome composition comprises an exogenous protein), the effect lasts for less than 1, 2, 3, 4, 5, 6, or 7 days, 2, 3, or 4 weeks, or 1, 2, 3, 6, or 12 months.

Ex-Vivo Applications

In embodiments, the fusosome composition described herein is delivered ex-vivo to a cell or tissue, e.g., a human cell or tissue. In embodiments, the composition improves function of a cell or tissue ex-vivo, e.g., improves cell viability, signaling, respiration, or other function (e.g., another function described herein).

In some embodiments, the composition is delivered to an ex vivo tissue that is in an injured state (e.g., from trauma, disease, hypoxia, ischemia or other damage).

In some embodiments, the composition is delivered to an ex-vivo transplant (e.g., a tissue explant or tissue for transplantation, e.g., a human vein, a musculoskeletal graft such as bone or tendon, cornea, skin, heart valves, nerves; or an isolated or cultured organ, e.g., an organ to be transplanted into a human, e.g., a human heart, liver, lung, kidney, pancreas, intestine, thymus, eye). The composition can be delivered to the tissue or organ before, during and/or after transplantation.

In some embodiments, the composition is delivered, administered or contacted with a cell, e.g., a cell preparation. The cell preparation may be a cell therapy preparation (a cell preparation intended for administration to a human subject). In embodiments, the cell preparation comprises cells expressing a chimeric antigen receptor (CAR), e.g., expressing a recombinant CAR. The cells expressing the CAR may be, e.g., T cells, Natural Killer (NK) cells, cytotoxic T lymphocytes (CTL), regulatory T cells. In embodiments, the cell preparation is a neural stem cell preparation. In embodiments, the cell preparation is a mesenchymal stem cell (MSC) preparation. In embodiments, the cell preparation is a hematopoietic stem cell (HSC) preparation. In embodiments, the cell preparation is an islet cell preparation.

In Vivo Uses

The fusosome compositions described herein can be administered to a subject, e.g., a mammal, e.g., a human. In such embodiments, the subject may be at risk of, may have a symptom of, or may be diagnosed with or identified as having, a particular disease or condition (e.g., a disease or condition described herein). In one embodiment, the subject has cancer. In one embodiment, the subject has an infectious disease.

In some embodiments, the source of fusosomes is from the same subject that is administered a fusosome composition. In other embodiments, they are different. For example, the source of fusosomes and recipient tissue may be autologous (from the same subject) or heterologous (from different subjects). In either case, the donor tissue for fusosome compositions described herein may be a different tissue type than the recipient tissue. For example, the donor tissue may be muscular tissue and the recipient tissue may be connective tissue (e.g., adipose tissue). In other embodiments, the donor tissue and recipient tissue may be of the same or different type, but from different organ systems.

A fusosome composition described herein may be administered to a subject having a cancer, an autoimmune disease, an infectious disease, a metabolic disease, a neurodegenerative disease, or a genetic disease (e.g., enzyme deficiency). In some embodiments, a tissue of the subject is in need of regeneration.

In some embodiments, a therapeutically effective amount of a fusosome composition described herein is administered to a subject. In some embodiments, a therapeutically effective amount of a substance is an amount that is sufficient, when administered to a subject who has or is susceptible to a disease, disorder, and/or condition, to treat, and/or delay the onset of the disease, disorder, and/or condition. For example, in embodiments the effective amount of a fusosome in a formulation to treat a disease, disorder, and/or condition is the amount that alleviates, ameliorates, relieves, inhibits, delays onset of, reduces severity of and/or reduces incidence of one or more symptoms or features of the disease, disorder, and/or condition.

In some embodiments, a subject is treated with a fusosome composition. In some embodiments, the treatment partially or completely alleviates, ameliorates, relieves, inhibits, delays onset of, reduces severity of, and/or reduces incidence of one or more symptoms, features, and/or causes of a particular disease, disorder, and/or condition. In some embodiments, treatment may be of a subject who has been diagnosed as suffering from the relevant disease, disorder, and/or condition. In some embodiments, treatment may be of a subject known to have one or more susceptibility factors that are statistically correlated with increased risk of development of the relevant disease, disorder, and/or condition. In some embodiments, treatment partially or completely ameliorates the root cause of the relevant disease, disorder, and/or condition.

In some embodiments, the fusosome composition is effective to treat the disease, e.g., cancer. In some embodiments, the fusosome composition is effective to reduce the number of cancer cells in the subject compared to the number of cancer cells in the subject before administration. In some embodiments, the fusosome composition is effective to reduce the number of cancer cells in the subject compared to the expected course of disease without treatment. In some embodiments, the subject experiences a complete response or partial response after administration of the fusosome composition.

In some embodiments, the fusosome is co-administered with an inhibitor of a protein that inhibits membrane fusion. For example, Suppressyn is a human protein that inhibits cell-cell fusion (Sugimoto et al., "A novel human endogenous retroviral protein inhibits cell-cell fusion" Scientific Reports 3:1462 DOI: 10.1038/srep01462). Thus, in some embodiments, the fusosome is co-administered with an inhibitor of sypressyn, e.g., a siRNA or inhibitory antibody.

Non-Human Applications

Compositions described herein may also be used to similarly modulate the cell or tissue function or physiology of a variety of other organisms including but not limited to: farm or working animals (horses, cows, pigs, chickens etc.), pet or zoo animals (cats, dogs, lizards, birds, lions, tigers and bears etc.), aquaculture animals (fish, crabs, shrimp, oysters etc.), plants species (trees, crops, ornamentals flowers etc), fermentation species (*saccharomyces* etc.). Fusosome compositions described herein can be made from such non-human sources and administered to a non-human target cell or tissue or subject.

Fusosome compositions can be autologous, allogeneic or xenogeneic to the target.

All references and publications cited herein are hereby incorporated by reference.

The following examples are provided to further illustrate some embodiments of the present invention, but are not intended to limit the scope of the invention; it will be understood by their exemplary nature that other procedures, methodologies, or techniques known to those skilled in the art may alternatively be used.

EXAMPLES

Example 1. Generating Enucleated Fusogenic Cells Via Chemical Treatment (PEG)

Mito-DsRed (a mitochondrial specific targeted dye) expressing donor HeLa cells were trypsinized with 0.25% trypsin, collected, spun at 500×g for 5 min, washed once in PBS and counted. $10\times10^6$ cells were subsequently resuspended in 3 ml of 12.5% ficoll in complete MEM-alpha (+10% FBS, +1% penicillin/streptomycin, +glutamine) supplemented with 10 ug/mL cytochalasin-B for 15 min. To enucleate cells, they were transferred to a discontinuous ficoll gradient consisting of the following ficoll fractions (from top to bottom): 2 mL 12.5% ficoll, 0.5 mL 15% ficoll, 0.5 mL 16% ficoll, 2 mL 17% ficoll gradient, 2 mL 25% ficoll. All ficoll gradient fractions were made in complete DMEM supplemented with 10 ug/mL cytochalasin-B. Gradients were spun on a Beckman SW-40 ultracentrifuge, Ti-70 rotor at 107971×g for 1 h at 37° C. Following centrifugation, enucleated HeLa cells were collected from the 12.5%, 15%, 16%, and ½ of the 17% ficoll fractions and resuspended in complete DMEM (+10% FBS, +1% penicillin/streptomycin, +glutamine), and spun at 500×g for 5 min to pellet. Enucleated Mito-DsRed donor cells were washed 2× in DMEM. Simultaneously, Mito-GFP (a mitochondrial specific targeted dye) expressing recipient HeLa cells were trypsinized, counted, and prepared for fusion.

For fusion, enucleated Mito-DsRed donor HeLa cells were combined at a 1:1 ratio with Mito-GFP recipient HeLa cells (200,000 each) in a 50% polyethylene glycol solution (50% PEG by w/v prepared in DMEM complete w/10% DMSO) for 1 minute at 37° C. Cells were subsequently washed 3× in 10 mL complete DMEM and plated on 35 mm glass-bottom quadrant imaging dishes at density of 50 k cells/quadrant, with each quadrant having an area of 1.9 $cm^2$.

Example 2. Generating Nucleated Fusogenic Cells Via Chemical Treatment (PEG)

Mito-DsRed (a mitochondrial specific targeted dye) expressing donor HeLa cells were trypsinized with 0.25% trypsin, collected, spun at 500×g for 5 min, washed once in PBS and counted. $2\times10^6$ cells were subsequently resuspended in complete DMEM (+10% FBS, +1% penicillin/streptomycin, +glutamine), counted, and prepared for fusion.

Mito-DsRed donor cells were washed 3× in DMEM. Simultaneously, Mito-GFP (a mitochondrial specific targeted dye) expressing recipient HeLa cells were trypsinized, counted, and prepared for fusion.

For fusion, Mito-DsRed donor HeLa cells were combined at a 1:1 ratio with Mito-GFP recipient HeLa cells (200,000 each) in a 50% polyethylene glycol solution (50% PEG by w/v prepared in DMEM complete w/10% DMSO) with for 1 minute at 37° C. Cells were subsequently washed 3× in 10 ml complete DMEM and plated on 35 mm glass-bottom quadrant imaging dishes at density of 50 k cells/quadrant, with each quadrant having an area of 1.9 $cm^2$.

Example 3. Creation of HeLa Cells Expressing Exogenous Fusogens

This example describes the creation of tissue culture cells expressing an exogenous fusogen. The following example is equally applicable to any protein based fusogen and is equally applicable to production in primary cells (in suspension or adherent) and tissue. In certain cases, a fusogen pair can be used to induce fusion (delineated as fusogen and a fusogen binding partner).

The fusogen gene, fusion failure 1 (EFF-1), is cloned into pIRES2-AcGFP1 vector (Clontech), and this construct is then transfected into HeLa cells (CCL-2™, ATCC) using the Lipofectamine 2000 transfection reagent (Invitrogen). The fusogen binding partner gene, anchor-cell fusion failure 1 (AFF-1), is cloned into pIRES2 DsRed-Express 2 vector (Clontech), and this construct is then transfected into HeLa cells (CCL-2™, ATCC) using the Lipofectamine 2000 transfection reagent (Invitrogen). Transfected HeLa cells are kept at 37° C., 5% CO2 in Dulbecco's Modified Eagle Medium (DMEM) supplemented with GlutaMAX (GIBCO), 10% fetal calf serum (GIBCO) and 500 mg/mL zeocin. EFF-1 expressing cells are isolated by sorting fluorescent activated cell sorting (FACS) to get a pure population of GFP+ Hela cells expressing EFF-1 fusogen. AFF-1 expressing cells are isolated by sorting fluorescent activated cell sorting (FACS) to get a pure population of DSRED+ Hela cells expressing AFF-1 fusogen binding partner.

Example 4. Organelle Delivery Via Chemically Enhanced Fusogenic Enucleated Cells Fusogenic cells (Mito-DsRed donor enucleated cells and Mito-GFP recipient HeLa cells) produced and fused as described in Example 1 were imaged on a Zeiss LSM 780 inverted confocal microscope at 63× magnification 24 h following deposition in the imaging dish. Cells expressing only Mito-DsRed alone and Mito-GFP alone were imaged separately to configure acquisition settings in such a way as to ensure no signal overlap between the two channels in conditions where both Mito-DsRed and Mito-GFP were both present and acquired simultaneously. Ten regions of interest were chosen in a completely unbiased manner, with the only criteria being that a minimum of 10 cells be contained within each ROI, such that a minimum of 100 cells were available for downstream analysis. A given pixel in these images was determined to be positive for mitochondria if its intensity for either channel (mito-DsRed and mito-GFP) was greater than 10% of the maximum intensity value for each respective channel across all three ROIs.

Figure 7:
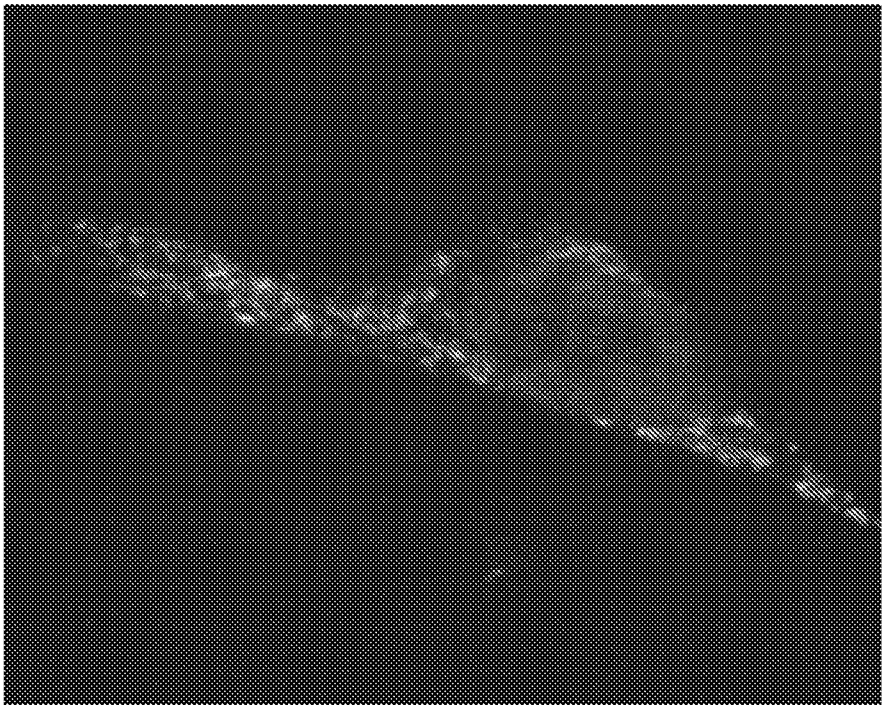
FIG. 7 is an image of a positive organelle delivery via fusion between donor and recipient HeLa cells. The intracellular areas indicated in white indicate overlap between donor and recipient mitochondria. The intracellular regions in grey indicate where donor and recipient organelles do not overlap.

Fusion events with organelle delivery were identified based on the criteria that >50% of the mitochondria (identified by all pixels that are either mito-GFP+ or mito-DsRed+) in a cell were positive for both mitoDs-Red and mito-GFP based on the above indicated threshold, indicating that organelles (in this case mitochondria) containing these proteins have been delivered, fused and their contents intermingled. At the 24-hour time point multiple cells exhibited positive organelle delivery via fusion as indicated in FIG. 7. This is the image of a positive organelle delivery via fusion between donor and recipient HeLa cells. The intracellular areas indicated in white indicate overlap between donor and recipient mitochondria. The intracellular regions in grey indicate where donor and recipient organelles do not overlap.

Example 5. Organelle Delivery Via Chemically Enhanced Fusogenic Nucleated Cells

Fusogenic cells (Mito-DsRed donor cells and Mito-GFP recipient HeLa cells) produced and combined as described in example 2 were imaged on a Zeiss LSM 780 inverted confocal microscope at 63× magnification 24 h following deposition in the imaging dish. Cells expressing only Mito-DsRed alone and Mito-GFP alone were imaged separately to configure acquisition settings in such a way as to ensure no signal overlap between the two channels in conditions where both Mito-DsRed and Mito-GFP were both present and acquired simultaneously. Ten regions of interest were chosen in a completely unbiased manner, with the only criteria being that a minimum of 10 cells be contained within each ROI, such that a minimum of 100 cells were available for downstream analysis. A given pixel in these images was determined to be positive for mitochondria if it's intensity for either channel (mito-DsRed and mito-GFP) was greater than 20% of the maximum intensity value for each respective channel across all three ROIs.

Figure 8:
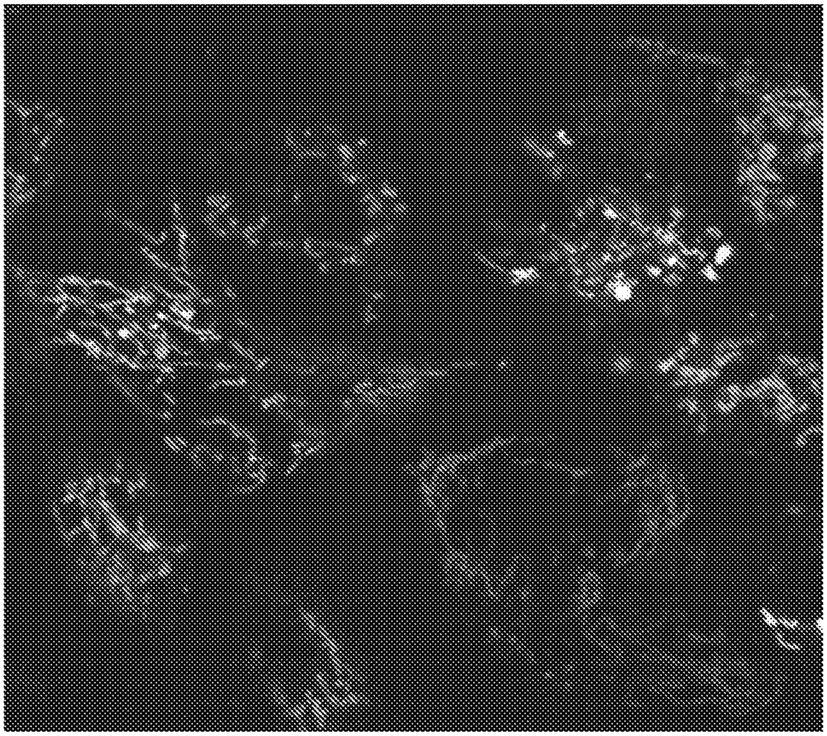
FIG. 8 is an image of a positive organelle delivery via fusion between donor and recipient HeLa cells. The intracellular areas indicated in white indicate overlap between donor and recipient mitochondria. The intracellular regions in grey indicate where donor and recipient organelles do not overlap.

Fusion events with organelle delivery were identified based on the criteria that >50% of the mitochondria (identified by all pixels that are either mito-GFP+ or mito-DsRed+) in a cell were positive for both mitoDs-Red and mito-GFP based on the above indicated threshold, indicating that organelles (in this case mitochondria) containing these proteins have been delivered, fused and their contents intermingled. At the 24-hour time point multiple cells exhibited positive organelle delivery via fusion as indicated in FIG. 8. This is the image of a positive organelle delivery via fusion between donor and recipient HeLa cells. The intracellular areas indicated in white indicate overlap between donor and recipient mitochondria. The intracellular regions in grey indicate where donor and recipient organelles do not overlap.

Example 6. Delivery of Mitochondria Via Protein Enhanced Fusogenic Enucleated Cells Fusogenic cells produced and combined as described in Example 3 are imaged on a Zeiss LSM 780 inverted confocal microscope at 63× magnification 24 h following deposition in the imaging dish. Cells expressing only Mito-DsRed alone and Mito-GFP alone are imaged separately to configure acquisition settings in such a way as to ensure no signal overlap between the two channels in conditions where both Mito-DsRed and Mito-GFP are both present and acquired simultaneously. Ten regions of interest are chosen in a completely unbiased manner, with the only criteria being that a minimum of 10 cells be contained within each ROI, such that a minimum number of cells are available for downstream analysis. A given pixel in these images is determined to be positive for mitochondria if it's intensity for either channel (mito-DsRed and mito-GFP) is greater than 10% of the maximum intensity value for each respective channel across all three ROIs.

Fusion events with organelle delivery will be identified based on the criteria that >50% of the mitochondria (identified by all pixels that are either mito-GFP+ or mito-DsRed+) in a cell are positive for both mitoDs-Red and mito-GFP based on the above indicated threshold, which will indicate that organelles (in this case mitochondria) containing these proteins are delivered, fused and their contents intermingled. At the 24-hour time point multiple cells are expected to exhibit positive organelle delivery via fusion.

Example 7: Generation of Fusosomes Through Nucleic Acid Electroporation

This example describes fusosome generation through electroporation of cells or vesicles with nucleic acids (e.g., mRNA or DNA) that encode a fusogen.

Transposase vectors (System Biosciences, Inc.) that include the open reading frame of the Puromycin resistance gene together with an open reading frame of a cloned fragment (e.g. Glycoprotein from Vesicular stomatitis virus [VSV-G], Oxford Genetics #0G592) are electroporated into 293Ts using an electroporator (Amaxa) and a 293T cell line specific nuclear transfection kit (Lonza).

Following selection with 1 μg/μL puromycin for 3-5 days in DMEM containing 20% Fetal Bovine Serum and 1× Penicillin/Streptomycin, the cells are then washed with 1×PBS, ice-cold lysis buffer (150 mM NaCl, 0.1% Triton X-100, 0.5% sodium deoxycholate, 0.1% SDS, 50 mM Tris-HCl, pH 8.0 and protease inhibitor cocktail (Abcam, ab201117)), sonicated 3 times, 10-15 secs per time and centrifuged at 16,000×g for 20 min. A western blot is conducted on the recovered supernatant fraction with a probe specific to VSV-G to determine the non-membrane specific concentration of VSV-G from the fusosomes prepared from stably transfected cells or control cells and compared to the standard of VSV-G protein.

In embodiments, the fusosomes from stably transfected cells will have more VSV-G than fusosomes generated from cells that were not stably transfected.

Example 8: Generation of Fusosomes Through Protein Electroporation

This example describes electroporation of fusogens to generate fusosomes.

Approximately $5\times10^{6}$ cells or vesicles are used for electroporation using an electroporation transfection system (Thermo Fisher Scientific). To set up a master mix, 24 μg of purified protein fusogens is added to resuspension buffer (provided in the kit). The mixture is incubated at room temperature for 10 min. Meanwhile, the cells or vesicles are transferred to a sterile test tube and centrifuged at 500×g for 5 min. The supernatant is aspirated and the pellet is resuspended in 1 mL of PBS without $Ca^{2+}$ and $Mg^{2+}$. The buffer with the fusogens is then used to resuspend the pellet of cells or vesicles. A cell or vesicle suspension is also used for optimization conditions, which vary in pulse voltage, pulse width and the number of pulses. After electroporation, the electroporated cells or vesicles with fusogens are washed with PBS, resuspended in PBS, and kept on ice.

See, for example, Liang et al., Rapid and highly efficiency mammalian cell engineering via Cas9 protein transfection, *Journal of Biotechnology* 208: 44-53, 2015.

Example 9: Generating and Isolating Fusosomes Through Vesicle Formation and Centrifugation This example describes fusosome generation and isolation via vesiculation and centrifugation. This is one of the methods by which fusosomes may be isolated.

Fusosomes are prepared as follows. Approximately 4×106 HEK-293T cells are seeded in a 10 cm dish in complete media (DMEM+10% FBS+Pen/Strep). One day after seeding, 15 μg of fusogen expressing plasmid or virus is delivered to cells. After a sufficient period of time for fusogen expression, medium is carefully replaced by fresh medium supplemented with 100 μM ATP. Supernatants are harvested 48-72 hours after fusogen expression, clarified by filtration through a 0.45 μm filter, and ultracentrifuged at 150,000×g for 1 h. Pelleted material is resuspended overnight in ice cold PBS. Fusosomes are resuspended in desired buffer for experimentation.

See for example, Mangeot et al., Molecular Therapy, vol. 19 no. 9, 1656-1666, September 2011

Example 10: Generating and Isolating Giant Plasma Membrane Fusosomes

This example describes fusosome generation and isolation via vesiculation and centrifugation. This is one of the methods by which fusosomes may be isolated. Fusosomes are prepared as follows.

Briefly, HeLa cells that express a fusogen are washed twice in buffer (10 mM HEPES, 150 mM NaCl, 2 mM $CaCl_2$, pH 7.4), resuspended in a solution (1 mM DTT, 12.5 mM Paraformaldehyde, and 1 mM N-ethylmaleimide in GPMV buffer), and incubated at 37° C. for 1 h. Fusosomes are clarified from cells by first removing cells by centrifugation at 100×g for 10 minutes, and then harvesting fusosomes at 20,000×g for 1 h at 4° C. The fusosomes are resuspended in desired buffer for experimentation.

See for example, Sezgin E et al. Elucidating membrane structure and protein behavior using giant membrane plasma vesicles. *Nat. Protocols.* 7(6):1042-51 2012.

Example 11: Generating and Isolating Fusosome Ghosts

This example describes fusosome generation and isolation via hypotonic treatment and centrifugation. This is one of the methods by which fusosomes may be produced.

First, fusosomes are isolated from mesenchymal stem cells expressing fusogens ($10^{9}$ cells) primarily by using hypotonic treatment such that the cell ruptures and fusosomes are formed. Cells are resuspended in hypotonic solution, Tris-magnesium buffer (TM, e.g., pH 7.4 or pH 8.6 at 4° C., pH adjustment made with HCl). Cell swelling is monitored by phase-contrast microscopy. Once the cells swell and fusosomes are formed, the suspension is placed in a homogenizer. Typically, about 95% cell rupture is sufficient as measured through cell counting and standard AOPI staining. The membranes/fusosomes are then placed in sucrose (0.25 M or higher) for preservation. Alternatively, fusosomes can be formed by other approaches known in the art to lyse cells, such as mild sonication (Arkhiv anatomii, gistologii i embriologii; 1979, August, 77(8) 5-13; PMID: 496657), freeze-thaw (Nature. 1999, Dec. 2; 402(6761):551-5; PMID: 10591218), French-press (Methods in Enzymology, Volume 541, 2014, Pages 169-176; PMID: 24423265), needle-passaging (www.sigmaaldrich.com/technical-documents/protocols/biology/nuclear-protein-extraction.html) or solublization in detergent-containing solutions (www.thermofisher.com/order/catalog/product/89900).

To avoid adherence, the fusosomes are placed in plastic tubes and centrifuged. A laminated pellet is produced in which the topmost lighter gray lamina includes mostly fusosomes. However, the entire pellet is processed, to increase yields. Centrifugation (e.g., 3,000 rpm for 15 min at 4° C.) and washing (e.g., 20 volumes of Tris magnesium/TM-sucrose pH 7.4) may be repeated.

In the next step, the fusosome fraction is separated by floatation in a discontinuous sucrose density gradient. A small excess of supernatant is left remaining with the washed pellet, which now includes fusosomes, nuclei, and incompletely ruptured whole cells. An additional 60% w/w sucrose in TM, pH 8.6, is added to the suspension to give a reading of 45% sucrose on a refractometer. After this step, all solutions are TM pH 8.6. 15 mL of suspension are placed in SW-25.2 cellulose nitrate tubes and a discontinuous gradient is formed over the suspension by adding 15 mL layers, respectively, of 40% and 35% w/w sucrose, and then adding 5 mL of TM-sucrose (0.25 M). The samples are then centrifuged at 20,000 rpm for 10 min, 4° C. The nuclei sediment form a pellet, the incompletely ruptured whole cells are collected at the 40%-45% interface, and the fusosomes are collected at the 35%-40% interface. The fusosomes from multiple tubes are collected and pooled. See for example, International patent publication, WO2011024172A2.

Example 12: Generating Fusosomes Through Extrusion

This example describes fusosome manufacturing by extrusion through a membrane.

Briefly, hematopoietic stem cells that express fusogens are in a 37° C. suspension at a density of $1\times10^6$ cells/mL in serum-free media containing protease inhibitor cocktail (Set V, Calbiochem 539137-1ML). The cells are aspirated with a luer lock syringe and passed once through a disposable 5 mm syringe filter into a clean tube. If the membrane fouls and becomes clogged, it is set aside and a new filter is attached. After the entire cell suspension has passed through the filter, 5 mL of serum-free media is passed through all filters used in the process to wash any remaining material through the filter(s). The solution is then combined with the extruded fusosomes in the filtrate.

Fusosomes may be further reduced in diameter by continued extrusion following the same method with increasingly smaller filter pore sizes, ranging from 5 mm to 0.2 mm. When the final extrusion is complete, suspensions are pelleted by centrifugation (time and speed required vary by size) and resuspended in media.

Additionally, this process can be supplemented with the use of an actin cytoskeleton inhibitor in order to decrease the influence of the existing cytoskeletal structure on extrusion. Briefly, a $1\times10^6$ cell/mL suspension is incubated in serum-free media with 500 nM Latrunculin B (ab144291, Abcam, Cambridge, MA) and incubated for 30 minutes at 37° C. in the presence of 5% CO2. After incubation, protease inhibitor cocktail is added and cells are aspirated into a luer lock syringe, with the extrusion carried out as previously described.

Fusosomes are pelleted and washed once in PBS to remove the cytoskeleton inhibitor before being resuspended in media.

Example 13: Generation of Fusosomes Through Chemical Treatment with Protein

This example describes chemical-mediated delivery of fusogens to generate fusosomes. Approximately $5\times10^6$ cells or vesicles are used for chemical-mediated delivery of fusogens. The cells or vesicles are suspended in 50 µL of Opti-MEM medium. To set up a master mix, 24 µg of purified protein fusogens is mixed with 25 µL of Opti-MEM medium, followed by the addition of 25 µL of Opti-MEM containing 2 µL of lipid transfection reagent 3000. The cells or vesicles and fusogen solutions are mixed by gently swirling the plate and incubating at 37 C for 6 hours, such that the fusogen will be incorporated into the cell or vesicle membrane. Fusosomes are then washed with PBS, resuspended in PBS, and kept on ice.

See, also, Liang et al., Rapid and highly efficiency mammalian cell engineering via Cas9 protein transfection, *Journal of Biotechnology* 208: 44-53, 2015.

Example 14: Generation of Fusosomes Through Treatment with Fusogen-Containing Liposomes This example describes liposome-mediated delivery of fusogens to a source cell to generate fusosomes. Approximately $5\times10^6$ cells or vesicles are used for liposome-mediated delivery of fusogens. The cells or vesicles are suspended in 50 µL of Opti-MEM medium. The fusogen protein is purified from cells in the presence of n-octyl b-D-glucopyranoside. n-octyl b-D-glucopyranoside is a mild detergent used to solubilize integral membrane proteins. The fusogen protein is then reconstituted into large (400 nm diameter) unilamellar vesicles (LUVs) by mixing n-octyl b-D-glucopyranoside-suspended protein with LUVs presaturated with n-octyl b-D-glucopyranoside, followed by removal of n-octyl b-D-glucopyranoside, as described in Top et al., *EMBO* 24: 2980-2988, 2005. To set up a master mix, a mass of liposomes that contains 24 µg of total fusogen protein is mixed with 50 µL of Opti-MEM medium. The solutions of liposomes and source cells or vesicles are then combined, and the entire solution is mixed by gently swirling the plate and incubating at 37 C for 6 hours under conditions that allow fusion of the fusogen-containing liposomes and the source cells or vesicle, such that the fusogen protein will be incorporated into the source cell or vesicle membrane. Fusosomes are then washed with PBS, resuspended in PBS, and kept on ice. See, also, Liang et al., Rapid and highly efficiency mammalian cell engineering via Cas9 protein transfection, *Journal of Biotechnology* 208: 44-53, 2015.

Example 15: Isolating Fusogenic Microvesicles Freely Released from Cells

This example describes isolation of fusosomes via centrifugation. This is one of the methods by which fusosomes may be isolated.

Fusosomes are isolated from cells expressing fusogens by differential centrifugation. Culture media (DMEM+10% fetal bovine serum) is first clarified of small particles by ultracentrifugation at >100,000×g for 1 h. Clarified culture media is then used to grow Mouse Embryonic Fibroblasts expressing fusogens. The cells are separated from culture media by centrifugation at 200×g for 10 minutes. Supernatants are collected and centrifuged sequentially twice at 500×g for 10 minutes, once at 2,000×g for 15 minutes, once at 10,000×g for 30 min, and once at 70,000×g for 60 minutes. Freely released fusosomes are pelleted during the final centrifugation step, resuspended in PBS and repelleted at 70,000×g. The final pellet is resuspended in PBS.

See also, Wubbolts R et al. Proteomic and Biochemical Analyses of Human B Cell-derived Exosomes: Potential Implications for their Function and Multivesicular Body Formation. *J. Biol. Chem.* 278:10963-10972 2003.

Example 16: Physical Enucleation of Fusosomes

This example describes enucleation of fusosomes via cytoskeletal inactivation and centrifugation. This is one of the methods by which fusosomes may be modified.

Fusosomes are isolated from mammalian primary or immortalized cell lines that express a fusogen. The cells are enucleated by treatment with an actin skeleton inhibitor and ultracentrifugation. Briefly, C2C12 cells are collected, pelleted, and resuspended in DMEM containing 12.5% Ficoll 400 (F2637, Sigma, St. Louis MO) and 500 nM Latrunculin B (ab144291, Abcam, Cambridge, MA) and incubated for 30 minutes at 37° C.+5% CO2. Suspensions are carefully layered into ultracentrifuge tubes containing increasing concentrations of Ficoll 400 dissolved in DMEM (15%, 16%, 17%, 18%, 19%, 20%, 3 mL per layer) that have been equilibrated overnight at 37° C. in the presence of 5% $CO_2$. Ficoll gradients are spun in a Ti-70 rotor (Beckman-Coulter, Brea, CA) at 32,300 RPM for 60 minutes at 37 C. After ultracentrifugation, fusosomes found between 16-18% Ficoll are removed, washed with DMEM, and resuspended in DMEM.

Staining for nuclear content with Hoechst 33342 as described in Example 35 followed by the use of flow cytometry and/or imaging will be performed to confirm the ejection of the nucleus.

Example 17: Modifying Fusosomes Via Irradiation

The following example describes modifying fusosomes with gamma irradiation. Without being bound by theory, gamma irradiation may cause double stranded breaks in the DNA and drive cells to undergo apoptosis.

First, cells expressing fusogens are cultured in a monolayer on tissue culture flasks or plates below a confluent density (e.g. by culturing or plating cells). Then the medium is removed from confluent flasks, cells are rinsed with Ca2+ and Mg2+ free HBSS, and trypsinized to remove the cells from the culture matrix. The cell pellet is then resuspended in 10 ml of tissue-culture medium without penicillin/streptomycin and transferred to a 100 mm Petri dish. The number of cells in the pellet should be equivalent to what would be obtained from 10-15 confluent MEF cultures on 150 $cm^2$ flasks. The cells are then exposed to 4000 rads from a γ-radiation source to generate fusosomes. The fusosomes are then washed and resuspended in the final buffer or media to be used.

Example 18: Modifying Fusosomes Via Chemical Treatment

The following example describes modifying fusosomes with mitomycin C treatment. Without being bound by any particular theory, mitomycin C treatment modifies fusosomes by inactivating the cell cycle.

First, cells expressing fusogens are cultured from a monolayer in tissue culture flasks or plates at a confluent density (e.g. by culturing or plating cells). One mg/mL mitomycin C stock solution is added to the medium to a final concentration of 10 μg/mL. The plates are then returned to the incubator for 2 to 3 hours. Then the medium is removed from confluent flasks, cells are rinsed with Ca2+ and Mg2+ free HBSS, and trypsinized to remove the cells from the culture matrix. The cells are then washed and resuspended in the final buffer or media to be used.

See for example, Mouse Embryo Fibroblast (MEF) Feeder Cell Preparation, Current Protocols in Molecular Biology. David A. Conner 2001.

Example 19: Lack of Transcriptional Activity in Fusosomes

This Example quantifies transcriptional activity in fusosomes compared to parent cells, e.g., source cells, used for fusosome generation. In some embodiments, transcriptional activity will be low or absent in fusosomes compared to the parent cells, e.g., source cells.

Fusosomes are a chassis for the delivery of therapeutic agent. Therapeutic agents, such as miRNA, mRNAs, proteins and/or organelles that can be delivered to cells or local tissue environments with high efficiency could be used to modulate pathways that are not normally active or active at pathological low or high levels in recipient tissue. In some embodiments, observation that fusosomes are not capable of transcription, or that fusosomes have transcriptional activity of less than their parent cell, will demonstrate that removal of nuclear material has sufficiently occurred.

Fusosomes are prepared by any one of the methods described in previous Examples. A sufficient number of fusosomes and parent cells used to generate the fusosomes are then plated into a 6 well low-attachment multiwell plate in DMEM containing 20% Fetal Bovine Serum, 1× Penicillin/Streptomycin and the fluorescent-taggable alkyne-nucleoside EU for 1 hr at 37° C. and 5% $CO_2$. For negative controls, a sufficient number of fusosomes and parent cells are also plated in multiwell plate in DMEM containing 20% Fetal Bovine Serum, 1× Penicillin/Streptomycin but with no alkyne-nucleoside EU.

After the 1 hour incubation the samples are processed following the manufacturer's instructions for an imaging kit (ThermoFisher Scientific). The cell and fusosome samples including the negative controls are washed thrice with 1×PBS buffer and resuspended in 1×PBS buffer and analyzed by flow cytometry (Becton Dickinson, San Jose, CA, USA) using a 488 nm argon laser for excitation, and the 530+/−30 nm emission. BD FACSDiva software was used for acquisition and analysis. The light scatter channels are set on linear gains, and the fluorescence channels on a logarithmic scale, with a minimum of 10,000 cells analyzed in each condition.

In some embodiments, transcriptional activity as measured by 530+/−30 nm emission in the negative controls will be null due to the omission of the alkyne-nucleoside EU. In some embodiments, the fusosomes will have less than about 70%, 60%, 50%, 40%, 30%, 20%, 10%, 5%, 4%, 3%, 2%, 1% or less transcriptional activity than the parental cells.

See also, Proc Natl Acad Sci USA, 2008, Oct. 14; 105(41):15779-84. doi: 10.1073/pnas.0808480105. Epub 2008 Oct. 7.

Example 20: Lack of DNA Replication or Replication Activity

This Example quantifies DNA replication in fusosomes. In some embodiments, fusosomes will replicate DNA at a low rate compared to cells.

Fusosomes are prepared by any one of the methods described in previous Examples. Fusosome and parental cell DNA replication activity is assessed by incorporation of a fluorescent-taggable nucleotide (ThermoFisher Scientific #C10632). Fusosomes and an equivalent number of cells are incubated with EdU at a final concentration of 10 μM for 2 hr, after preparation of an EdU stock solution with in dimethylsulfoxide. The samples are then fixed for 15 min using 3.7% PFA, washed with 1×PBS buffer, pH 7.4 and permeabilized for 15 min in 0.5% detergent solution in 1×PBS buffer, pH 7.4.

After permeabilization, fusosomes and cells in suspension in PBS buffer containing 0.5% detergent are washed with 1×PBS buffer, pH 7.4 and incubated for 30 min at 21° C. in reaction cocktail, 1×PBS buffer, CuSO4 (Component F), azide-fluor 488, 1× reaction buffer additive.

A negative control for fusosome and cell DNA replication activity is made with samples treated the same as above but with no azide-fluor 488 in the 1× reaction cocktail.

The cell and fusosome samples are then washed and resuspended in 1×PBS buffer and analyzed by flow cytometry. Flow cytometry is done with a FACS cytometer (Becton Dickinson, San Jose, CA, USA) with 488 nm argon laser excitation, and a 530+/−30 nm emission spectrum is collected. FACS analysis software is used for acquisition and analysis. The light scatter channels are set on linear gains, and the fluorescence channels on a logarithmic scale, with a minimum of 10,000 cells analyzed in each condition. The relative DNA replication activity is calculated based on the median intensity of azide-fluor 488 in each sample. All events are captured in the forward and side scatter channels (alternatively, a gate can be applied to select only the fusosome population). The normalized fluorescence intensity value for the fusosomes is determined by subtracting from the median fluorescence intensity value of the fusosome the median fluorescence intensity value of the respective negative control sample. Then the normalized relative DNA replication activity for the fusosomes samples is normalized to the respective nucleated cell samples in order to generate quantitative measurements for DNA replication activity.

In some embodiments, fusosomes have less DNA replication activity than parental cells.

See, also, Salic, 2415-2420, doi: 10.1073/pnas.0712168105.

Example 21: Electroporation to Modify Fusosome with Nucleic Acid Cargo

This example describes electroporation of fusosomes with nucleic acid cargo.

Fusosomes are prepared by any one of the methods described in a previous Example. Approximately $10^9$ fusosomes and 1 μg of nucleic acids, e.g., RNA, are mixed in electroporation buffer (1.15 mM potassium phosphate pH 7.2, 25 mM potassium chloride, 60% iodixanol w/v in water). The fusosomes are electroporated using a single 4 mm cuvette using an electroporation system (BioRad, 165-2081). The fusosomes and nucleic acids are electroporated at 400 V, 125 μF and ∞ ohms, and the cuvette is immediately transferred to ice. After electroporation, fusosomes are washed with PBS, resuspended in PBS, and kept on ice.

See, for example, Kamerkar et al., Exosomes facilitate therapeutic targeting of oncogenic KRAS in pancreatic cancer, *Nature,* 2017

Example 22: Electroporation to Modify Fusosome with Protein Cargo

This example describes electroporation of fusosomes with protein cargo.

Fusosomes are prepared by any one of the methods described in a previous Example. Approximately $5\times10^6$ fusosomes are used for electroporation using an electroporation transfection system (Thermo Fisher Scientific). To set up a master mix, 24 μg of purified protein cargo is added to resuspension buffer (provided in the kit). The mixture is incubated at room temperature for 10 min. Meanwhile, fusosomes are transferred to a sterile test tube and centrifuged at 500×g for 5 min. The supernatant is aspirated and the pellet is resuspended in 1 mL of PBS without $Ca^{2+}$ and $Mg^{2+}$. The buffer with the protein cargo is then used to resuspend the pellet of fusosomes. A fusosome suspension is then used for optimization conditions, which vary in pulse voltage, pulse width and the number of pulses. After electroporation, fusosomes are washed with PBS, resuspended in PBS, and kept on ice.

See, for example, Liang et al., Rapid and highly efficiency mammalian cell engineering via Cas9 protein transfection, *Journal of Biotechnology* 208: 44-53, 2015.

Example 23: Chemical Treatment of Fusosomes to Modify with Nucleic Acid Cargo

This example describes loading of nucleic acid cargo into a fusosome via chemical treatments.

Fusosomes are prepared by any one of the methods described in previous Examples. Approximately $10^6$ fusosomes are pelleted by centrifugation at 10,000 g for 5 min at 4° C. The pelleted fusosomes are then resuspended in TE buffer (10 mM Tris-HCl (pH 8.0), 0.1 mM EDTA) with 20 μg DNA. The fusosome:DNA solution is treated with a mild detergent to increase DNA permeability across the fusosome membrane (Reagent B, Cosmo Bio Co., LTD, Cat #ISK-GN-001-EX). The solution is centrifuged again and the pellet is resuspended in buffer with a positively-charged peptide, such as protamine sulfate, to increase affinity between the DNA loaded fusosomes and the target recipient cells (Reagent C, Cosmo Bio Co., LTD, Cat #ISK-GN-001-EX). After DNA loading, the loaded fusosomes are kept on ice before use.

See, also, Kaneda, Y., et al., New vector innovation for drug delivery: development of fusogenic non-viral particles. *Curr. Drug Targets,* 2003

Example 24: Chemical Treatment of Fusosomes to Modify with Protein Cargo

This example describes loading of protein cargo into a fusosome via chemical treatments.

Fusosomes are prepared by any one of the methods described in previous Examples. Approximately $10^6$ fusosomes are pelleted by centrifugation at 10,000 g for 5 min at 4° C. The pelleted fusosomes are then resuspended in buffer with positively-charged peptides, such as protamine sulfate, to increase the affinity between the fusosomes and the cargo proteins (Reagent A, Cosmo Bio Co., LTD, Cat #ISK-GN-001-EX). Next 10 μg of cargo protein is added to the fusosome solution followed by addition of a mild detergent to increase protein permeability across the fusosome membrane (Reagent B, Cosmo Bio Co., LTD, Cat #ISK-GN-001-EX). The solution is centrifuged again and the pellet is resuspended in buffer with the positively-charged peptide, such as protamine sulfate, to increase affinity between the protein loaded fusosomes and the target recipient cells (Reagent C, Cosmo Bio Co., LTD, Cat #ISK-GN-001-EX). After protein loading, the loaded fusosomes are kept on ice before use.

See, also, Yasouka, E., et al., Needleless intranasal administration of HVJ-E containing allergen attenuates experimental allergic rhinitis. *J. Mol. Med.,* 2007

Example 25: Transfection of Fusosomes to Modify with Nucleic Acid Cargo

This example describes transfection of nucleic acid cargo into a fusosome. Fusosomes are prepared by any one of the methods described in previous Examples.

$5\times10^6$ fusosomes are maintained in Opti-Mem. 0.5 μg of nucleic acid is mixed with 25 μL of Opti-MEM medium, followed by the addition of 25 μL of Opti-MEM containing 2 μL of lipid transfection reagent 2000. The mixture of nucleic acids, Opti-MEM, and lipid transfection reagent is maintained at room temperature for 15 minutes, then is added to the fusosomes. The entire solution is mixed by gently swirling the plate and incubating at 37 C for 6 hours. Fusosomes are then washed with PBS, resuspended in PBS, and kept on ice.

See, also, Liang et al., Rapid and highly efficiency mammalian cell engineering via Cas9 protein transfection, *Journal of Biotechnology* 208: 44-53, 2015.

Example 26: Transfection of Fusosomes to Modify with Protein Cargo

This example describes transfection of protein cargo into a fusosome.

Fusosomes are prepared by any one of the methods described in previous Examples. $5\times10^6$ fusosomes are maintained in Opti-Mem. 0.5 μg of purified protein is mixed with 25 μL of Opti-MEM medium, followed by the addition of 25 μL of Opti-MEM containing 2 μL of lipid transfection reagent 3000. The mixture of protein, Opti-MEM, and lipid transfection reagent is maintained at room temperature for 15 minutes, then is added to the fusosomes. The entire solution is mixed by gently swirling the plate and incubating at 37 C for 6 hours. Fusosomes are then washed with PBS, resuspended in PBS, and kept on ice.

See, also, Liang et al., Rapid and highly efficiency mammalian cell engineering via Cas9 protein transfection, *Journal of Biotechnology* 208: 44-53, 2015.

Example 27: Fusosomes with Lipid Bilayer Structure

This example describes the composition of fusosomes. In some embodiments, a fusosome composition will comprise a lipid bilayer structure, with a lumen in the center.

Without wishing to be bound by theory, the lipid bilayer structure of a fusosome promotes fusion with a target cell, and allows fusosomes to load different therapeutics.

Fusosomes are freshly prepared using the methods described in the previous Examples. The positive control is the native cell line (HEK293), and the negative control is cold DPBS and membrane-disrupted HEK293 cell prep, which has been passed through 36 gauge needles for 50 times.

Samples are spin down in Eppendorf tube, and the supernatant is carefully removed. Then a pre-warmed fixative solution (2.5% glutaraldehyde in 0.05 M cacodylate buffer with 0.1M NaCl, pH 7.5; keep at 37° C. for 30 min before use) is added to the sample pellet and kept at room temperature for 20 minutes. The samples are washed twice with PBS after fixation. Osmium tetroxide solution is added to the sample pellet and incubated 30 minutes. After rinsing once with PBS, 30%, 50%, 70% and 90% hexylene glycol is added and washed with swirling, 15 minutes each. Then 100% hexylene glycol is added with swirling, 3 times, 10 minutes each.

Resin is combined with hexylene glycol at 1:2 ratio, and then added to the samples and incubated at room temperature for 2 hours. After incubation, the solution is replaced with 100% resin and incubated for 4-6 hours. This step is repeated one more time with fresh 100% resin. Then it is replaced with 100% fresh resin, the level is adjusted to ~1-2 mm in depth, and baked for 8-12 hours. The Eppendorf tube is cut and pieces of epoxy cast with the sample is baked for an additional 16-24 hours. The epoxy cast is then cut into small pieces making note of the side with the cells. Pieces are glued to blocks for sectioning, using commercial 5-minute epoxy glue. A transmission electron microscope (JOEL, USA) is used to image the samples at a voltage of 80 kV.

In some embodiments, fusosomes will show a lipid bilayer structure similar to the positive control (HEK293 cells), and no obvious structure is observed in the DPBS control. In some embodiments no lumenal structures will be observed in the disrupted cell preparation.

Example 28: Detecting Fusogen Expression

This example quantifies fusogen expression in fusosomes.

Transposase vectors (System Biosciences, Inc.) that include the open reading frame of the Puromycin resistance gene together with an open reading frame of a cloned fragment (e.g. Glycoprotein from Vesicular stomatitis virus [VSV-G], Oxford Genetics #0G592) are electroporated into 293 Ts using an electroporator (Amaxa) and a 293T cell line specific nuclear transfection kit (Lonza).

Following selection with 1 μg/μL puromycin for 3-5 days in DMEM containing 20% Fetal Bovine Serum and 1× Penicillin/Streptomycin, fusosomes are prepared from the stably expressing cell line or from control cells by any one of the methods described in previous Examples.

The fusosomes are then washed with 1×PBS, ice-cold lysis buffer (150 mM NaCl, 0.1% Triton X-100, 0.5% sodium deoxycholate, 0.1% SDS, 50 mM Tris-HCl, pH 8.0 and Protease Inhibitor Cocktail III (Abcam, ab201117)), sonicated 3 times, 10-15 seconds each time and centrifuged at 16,000×g for 20 min. A western blot is conducted on the recovered supernatant fraction with a probe specific to VSV-G to determine the non-membrane specific concentration of VSV-G from the fusosomes prepared from stably transfected cells or control cells and compared to the standard of VSV-G protein.

In some embodiments, fusosomes from stably transfected cells will have more VSV-G than fusosomes generated from cells that were not stably transfected.

Example 29: Quantification of Fusogens

This example describes quantification of the absolute number of fusogens per fusosome.

A fusosome composition is produced by any one of the methods described in the previous Examples, except the fusosome is engineered as described in a previous Example to express a fusogen (VSV-G) tagged with GFP. In addition, a negative control fusosome is engineered with no fusogen (VSV-G) or GFP present.

The fusosomes with the GFP-tagged fusogen and the negative control(s) are then assayed for the absolute number of fusogens as follows. Commercially acquired recombinant GFP is serially diluted to generate a calibration curve of protein concentration. The GFP fluorescence of the calibration curve and a sample of fusosomes of known quantity is then measured in a fluorimeter using a GFP light cube (469/35 excitation filter and a 525/39 emission filter) to calculate the average molar concentration of GFP molecules in the fusosome preparation. The molar concentration is then converted to the number of GFP molecules and divided by the number of fusosomes per sample to achieve an average number of GFP-tagged fusogen molecules per fusosome and thus provides a relative estimate of the number of fusogens per fusosome.

In some embodiments, GFP fluorescence will be higher in the fusosomes with GFP tag as compared to the negative controls, where no fusogen or GFP is present. In some embodiments, GFP fluorescence is relative to the number of fusogen molecules present.

Alternatively, individual fusosomes are isolated using a single cell prep system (Fluidigm) per manufacturer's instructions, and qRT-PCR is performed using a commercially available probeset (Taqman) and master mix designed to quantify fusogen or GFP cDNA levels based upon the $C_t$ value. A RNA standard of the same sequence as the cloned fragment of the fusogen gene or the GFP gene is generated by synthesis (Amsbio) and then added to single cell prep system qRT-PCR experimental reaction in serial dilutions to establish a standard curve of $C_t$ vs concentration of fusogen or GFP RNA.

The $C_t$ value from fusosomes is compared to the standard curve to determine the amount of fusogen or GFP RNA per fusosome.

In some embodiments, fusogen and GFP RNA will be higher in the fusosomes with engineered to express the fusogens as compared to the negative controls, where no fusogen or GFP is present.

Fusogens may further be quantified in the lipid bilayer by analyzing the lipid bilayer structure as previously described and quantifying fusogens in the lipid bilayer by LC-MS as described in other Examples herein.

Example 30: Measuring the Average Diameter of Fusosomes

This Example describes measurement of the average diameter of fusosomes.

Fusosomes are prepared by any one of the methods described in previous Examples. The fusosomes measured to determine the average diameter using commercially available systems (iZON Science). The system is used with software according to manufacturer's instructions and a nanopore designed to analyze particles within the 40 nm to 10 μm diameter range. Fusosomes and parental cells are resuspended in phosphate-buffered saline (PBS) to a final concentration range of 0.01-0.1 μg protein/mL. Other instrument settings are adjusted as indicated in the following table:

TABLE 18

Fusosome measurement parameters and settings

| Measurement Parameter | Setting |
|---|---|
| Pressure | 6 |
| Nanopore type | NP300 |
| Calibration sample | CPC400_6P |
| Gold standard analysis | no |
| Capture assistant | none |

All fusosomes are analyzed within 2 hours of isolation. In some embodiments, fusosomes will have a diameter within about 1%, 2%, 3%, 4%, 5%, 10%, 20%, 30%, 40%, 50%, 60%, 70%, 80%, 90%, or greater than parental source cells.

Example 31: Measuring the Average Diameter Distribution of Fusosomes

This Example describes measurement of the diameter distribution of fusosomes.

Fusosomes are generated by any one of the methods described in previous Examples, and are tested to determine the average diameter of particles using a commercially available system, such as described in a previous Example. In some embodiments, diameter thresholds for 10%, 50%, and 90% of the fusosomes centered around the median are compared to parental cells to assess fusosome diameter distribution.

In some embodiments, fusosomes will have less than about 90%, 80%, 70%, 60%, 50%, 40%, 30%, 20%, 10%, 5%, or less of the parental cell's variability in diameter distribution within 10%, 50%, or 90% of the sample.

Example 32: Average Volume of Fusosomes

This example describes measurement of the average volume of fusosomes. Without wishing to be bound by theory, varying the size (e.g., diameter, volume, surface area, etc.) of fusosomes can make them versatile for distinct cargo loading, therapeutic design or application.

Fusosomes are prepared as described in previous Examples. The positive control is HEK293 cells or polystyrene beads with a known size. The negative control is HEK293 cells that are passed through a 36 gauge needle approximately 50 times.

Analysis with a transmission electron microscope, as described in a previous Example, is used to determine the size of the fusosomes. The diameter of the fusosome is measured and volume is then calculated.

In some embodiments, fusosomes will have an average size of approximately 50 nm or greater in diameter.

Example 33: Average Density of Fusosomes

Fusosome density is measured via a continuous sucrose gradient centrifugation assay as described in Thèry et al., Curr Protoc Cell Biol. 2006 April; Chapter 3:Unit 3.22. Fusosomes are obtained as described in previous Examples.

First, a sucrose gradient is prepared. A 2 M and a 0.25 sucrose solution are generated by mixing 4 mL HEPES/sucrose stock solution and 1 mL HEPES stock solution or 0.5 mL HEPES/sucrose stock solution and 4.5 mL HEPES stock solution, respectively. These two fractions are loaded into the gradient maker with all shutters closed, the 2 M sucrose solution in the proximal compartment with a magnetic stir bar, and the 0.25 M sucrose solution in the distal compartment. The gradient maker is placed on a magnetic stir plate, the shutter between proximal and distal compartments is opened and the magnetic stir plate is turned on. HEPES stock solution is made as follows: 2.4 g N-2-hydroxyethylpiperazine-N'-2-ethanesulfonic acid (HEPES; 20 mMfinal), 300 H2O, adjust pH to 7.4 with 10 N NaOH and finally adjust volume to 500 mL with H2O. HEPES/sucrose stock solution is made as follows: 2.4 g hydroxyethylpiperazine-N'-2-ethanesulfonic acid (HEPES; 20 mM final), 428 g protease-free sucrose (ICN; 2.5 M final), 150 mL H2O, adjust pH to 7.4 with 10 N NaOH and finally adjust volume to 500 mL with H2O.

The fusosomes are resuspended in 2 mL of HEPES/sucrose stock solution and are poured on the bottom of an SW 41 centrifuge tube. The outer tubing is placed in the SW 41 tube, just above the 2 mL of fusosomes. The outer shutter is opened, and a continuous 2 M (bottom) to 0.25 M (top) sucrose gradient is slowly poured on top of the fusosomes. The SW 41 tube is lowered as the gradient is poured, so that the tubing is always slightly above the top of the liquid.

All tubes with gradients are balanced with each other, or with other tubes having the same weight of sucrose solutions. The gradients are centrifuged overnight (>14 hr) at 210,000×g, 4° C., in the SW 41 swinging-bucket rotor with the brake set on low.

With a micropipettor, eleven 1-mL fractions, from top to bottom, are collected and placed in a 3-mL tube for the TLA-100.3 rotor. The samples are set aside and, in separate wells of a 96-well plate, 50 μl of each fraction is used to measure the refractive index. The plate is covered with adhesive foil to prevent evaporation and stored for no more than 1 hour at room temperature. A refractometer is used to measure the refractive index (hence the sucrose concentration, and the density) of 10 to 20 μl of each fraction from the material saved in the 96-well plate.

A table for converting the refractive index into g/mL is available in the ultracentrifugation catalog downloadable from the Beckman website.

Each fraction is then prepared for protein content analysis. Two milliliters of 20 mM HEPES, pH 7.4, is added to each 1-mL gradient fraction, and mixed by pipetting up and down two to three times. One side of each tube is marked with a permanent marker, and the tubes are placed marked side up in a TLA-100.3 rotor.

The 3 mL-tubes with diluted fractions are centrifuged for 1 hr at 110,000×g, 4° C. The TLA-100.3 rotor holds six tubes, so two centrifugations for each gradient is performed with the other tubes kept at 4° C. until they can be centrifuged.

The supernatant is aspirated from each of the 3-mL tubes, leaving a drop on top of the pellet. The pellet most probably is not visible, but its location can be inferred from the mark on the tube. The invisible pellet is resuspended and transferred to microcentrifuge tubes. Half of each resuspended fraction is used for protein contentment analysis by bicinchoninic acid assay, described in another Example. This provides a distribution across the various gradient fractions of the fusosome preparation. This distribution is used to determine the average density of the fusosomes. The second half volume fraction is stored at −80° C. and used for other purposes (e.g. functional analysis, or further purification by immunoisolation) once protein analysis has revealed the fusosome distribution across fractions.

In some embodiments, using this assay or an equivalent, the average density of the preparation comprising a plurality of fusosomes will be 1.25 g/mL+/−0.05 standard deviation. In some embodiments, the average density of the preparation will be in the range of 1-1.1, 1.05-1.15, 1.1-1.2, 1.15-1.25, 1.2-1.3, or 1.25-1.35 g/mL. In some embodiments, average density of the preparation will be less than 1 or more than 1.35.

Example 34: Measuring Organelle Content in Fusosomes

This Example describes detection of organelles in fusosomes.

Fusosomes were prepared as described herein. For detection of endoplasmic reticulum (ER) and mitochondria, fusosomes or C2C12 cells were stained with 1 μM ER stain (E34251, Thermo Fisher, Waltham, MA) and 1 μM mitochondria stain (M22426, Thermo Fisher Waltham, MA). For detection of lysosomes, fusosomes or cells were stained with 50 nM lysosome stain (L7526, Thermo Fisher, Waltham, MA).

Stained fusosomes were run on a flow cytometer (Thermo Fisher, Waltham, MA) and fluorescence intensity was measured for each dye according to the table below. Validation for the presence of organelles was made by comparing fluorescence intensity of stained fusosomes to unstained fusosomes (negative control) and stained cells (positive control).

Figure 2:
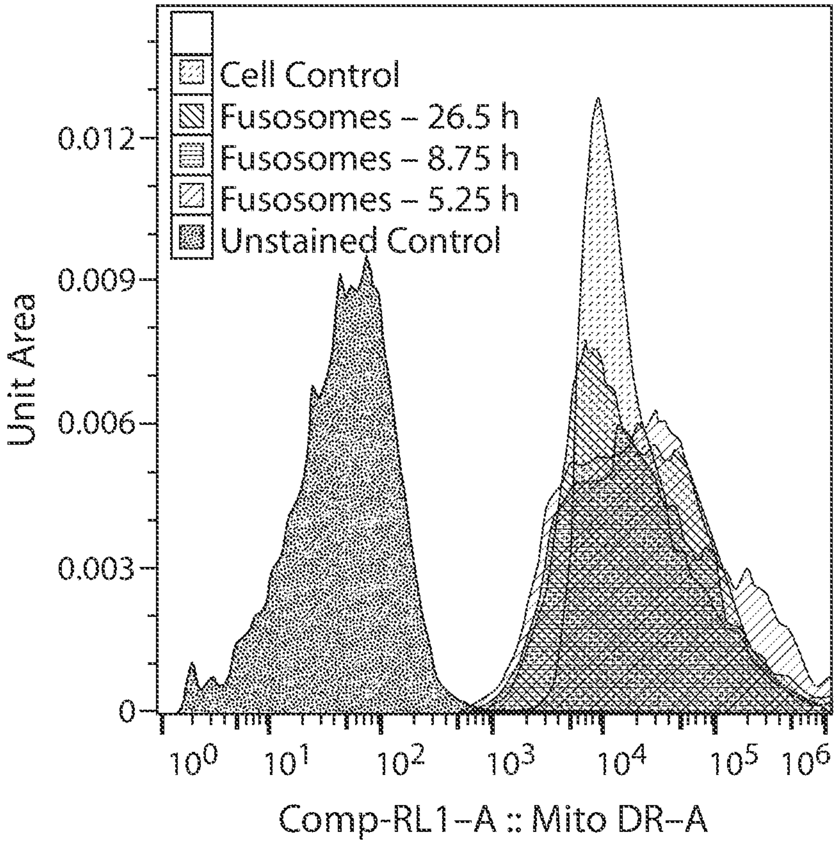
FIG. 2 quantifies staining of fusosomes with a dye for mitochondria.
Figure 3:
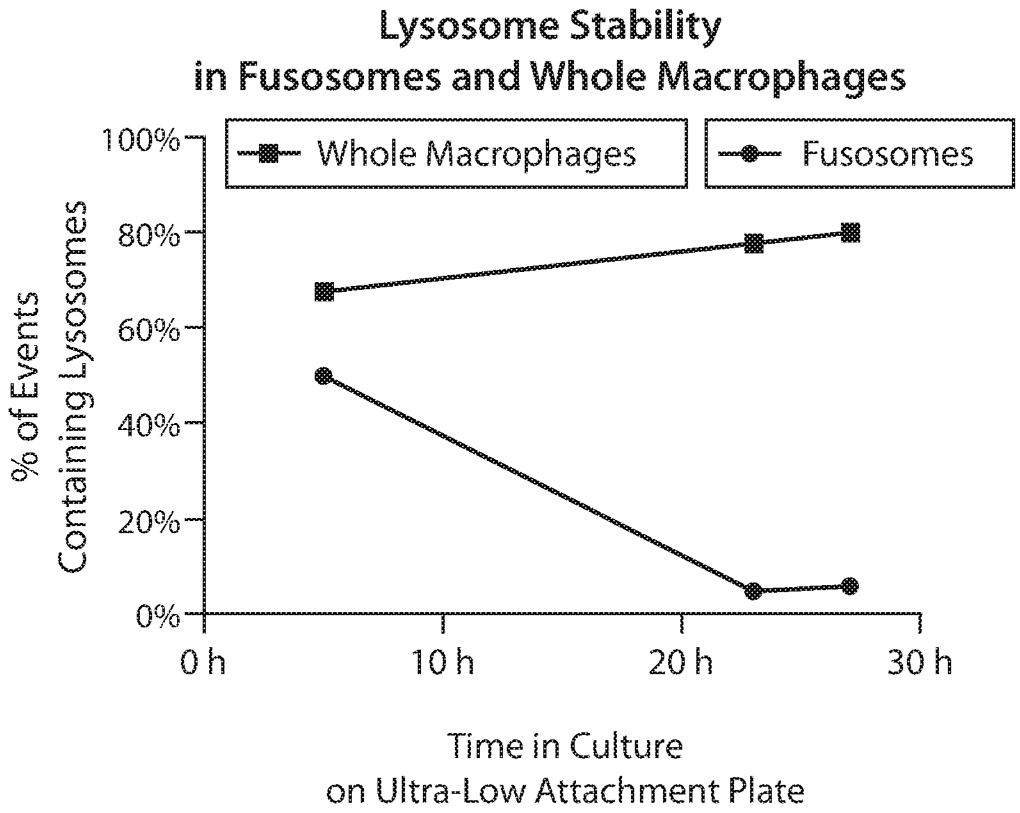
FIG. 3 quantifies staining of fusosomes with a dye for lysosomes.

Fusosomes stained positive for endoplasmic reticulum (FIG. 1), mitochondria (FIG. 2), and lysosomes (FIG. 3) 5 hours post-enucleation.

TABLE 19

Fusosome stains

| Stain | Attune Laser/Filter | Laser Wavelength | Emission Filter (nm) |
|---|---|---|---|
| Hoechst 33342 | VL1 | 405 | 450/40 |
| ER-Tracker Green | BL1 | 488 | 530/30 |
| MitoTracker Deep Red FM | RL1 | 638 | 670/14 |
| LysoTracker Green | BL1 | 488 | 530/30 |

Example 35: Measuring Nuclear Content in Fusosomes

This Example describes measuring nuclear content in a fusosome. To validate that fusosomes do not contain nuclei, fusosomes are stained with 1 $\mu g \cdot mL^{-1}$ Hoechst 33342 and 1 μM CalceinAM (C3100MP, Thermo Fisher, Waltham, MA) and the stained fusosomes are run on an Attune NXT Flow Cytometer (Thermo Fisher, Waltham, MA) to determine the fluorescence intensity of each dye according to the table below. In some embodiments, validation for the presence of cytosol (CalceinAM) and the absence of a nucleus (Hoechst 33342) will be made by comparing the mean fluorescence intensity of stained fusosomes to unstained fusosomes and stained cells.

TABLE 20

Flow cytometer settings

| Stain | Attune Laser/Filter | Laser Wavelength | Emission Filter (nm) |
|---|---|---|---|
| Hoechst 33342 | VL1 | 405 | 450/40 |
| Calcein AM | BL1 | 488 | 530/30 |

Example 36: Measuring Nuclear Envelope Content

This Example describes a measurement of the nuclear envelope content in enucleated fusosomes. The nuclear envelope isolates DNA from the cytoplasm of the cell.

In some embodiments, a purified fusosome composition comprises a mammalian cell, such as HEK-293 Ts (293 [HEK-293] (ATCC® CRL-1573™), that has been enucleated as described herein. This Example describes the quantification of different nuclear membrane proteins as a proxy to measure the amount of intact nuclear membrane that remains after fusosome generation.

In this Example, $10\times10^6$ HEK-293 Ts and the equivalent amount of fusosomes prepared from $10\times10^6$ HEK-293 Ts are fixed for 15 min using 3.7% PFA, washed with 1×PBS buffer, pH 7.4 and permeabilized simultaneously, and then blocked for 15 min using 1×PBS buffer containing 1% Bovine Serum Albumin and 0.5% Triton® X-100, pH 7.4. After permeabilization, fusosomes and cells are incubated for 12 hours at 4° C. with different primary antibodies, e.g. (anti-RanGAP1 antibody [EPR3295] (Abcam—ab92360), anti-NUP98 antibody [EPR6678]—nuclear pore marker (Abcam—ab124980), anti-nuclear pore complex proteins antibody [Mab414]-(Abcam—ab24609), anti-importin 7 antibody (Abcam—ab213670), at manufacturer suggested concentrations diluted in 1×PBS buffer containing 1% bovine serum albumin and 0.5% Triton® X-100, pH 7.4. Fusosomes and cells are then washed with 1×PBS buffer, pH 7.4, and incubated for 2 hr at 21° C. with an appropriate fluorescent secondary antibody that detects the previous specified primary antibody at manufacturer suggested concentrations diluted in 1×PBS buffer containing 1% bovine serum albumin and 0.5% detergent, pH 7.4. Fusosomes and cells are then washed with 1×PBS buffer, re-suspended in 300 μL of 1×PBS buffer, pH 7.4 containing 1 μg/mL Hoechst 33342, filtered through a 20 μm FACS tube and analyzed by flow cytometry.

Negative controls are generated using the same staining procedure but with no primary antibody added. Flow cytometry is performed on a FACS cytometer (Becton Dickinson, San Jose, CA, USA) with 488 nm argon laser excitation, and a 530+/−30 nm emission spectrum is collected. FACS acquisition software is used for acquisition and analysis. The light scatter channels are set on linear gains, and the fluorescence channels on a logarithmic scale, with a minimum of 10,000 cells analyzed in each condition. The relative intact nuclear membrane content is calculated based on the median intensity of fluorescence in each sample. All events are captured in the forward and side scatter channels.

The normalized fluorescence intensity value for the fusosomes is determined by subtracting from the median fluorescence intensity value of the fusosome the median fluorescence intensity value of the respective negative control sample. Then the normalized fluorescence for the fusosomes samples is normalized to the respective nucleated cell samples in order to generate quantitative measurements of intact nuclear membrane content.

In some embodiments, enucleated fusosomes will comprise less than 1%, 2%, 3%, 4%, 5%, 10%, 20%, 30%, 40%, 50%, 60%, 70%, 80%, or 90% fluorescence intensity or nuclear envelope content compared to the nucleated parental cells.

Example 37: Measuring Chromatin Levels

This Example describes measurement of chromatin in enucleated fusosomes.

DNA can be condensed into chromatin to allow it to fit inside the nucleus. In some embodiments, a purified fusosome composition as produced by any one of the methods described herein will comprise low levels of chromatin.

Enucleated fusosomes prepared by any of the methods previously described and positive control cells (e.g., parental cells) are assayed for chromatin content using an ELISA with antibodies that are specific to histone protein H3 or histone protein H4. Histones are the chief protein component of chromatin, with H3 and H4 the predominant histone proteins.

Histones are extracted from the fusosome preparation and cell preparation using a commercial kit (e.g. Abcam Histone Extraction Kit (ab113476)) or other methods known in the art. These aliquots are stored at −80° C. until use. A serial dilution of standard is prepared by diluting purified histone protein (either H3 or H4) from 1 to 50 ng/μL in a solution of the assay buffer. The assay buffer may be derived from a kit supplied by a manufacturer (e.g. Abcam Histone H4 Total Quantification Kit (ab156909) or Abcam Histone H3 total Quantification Kit (ab115091)). The assay buffer is added to each well of a 48- or 96-well plate, which is coated with an anti-histone H3 or anti-H4 antibody and sample or standard control is added to the well to bring the total volume of each well to 50 μL. The plate is then covered and incubated at 37 degrees for 90 to 120 minutes.

After incubation, any histone bound to the anti-histone antibody attached to the plate is prepared for detection. The supernatant is aspirated and the plate is washed with 150 μL of wash buffer. The capture buffer, which includes an anti-histone H3 or anti-H4 capture antibody, is then added to the plate in a volume of 50 μL and at a concentration of 1 μg/mL. The plate is then incubated at room temperature on an orbital shaker for 60 minutes.

Next, the plate is aspirated and washed 6 times using wash buffer. Signal reporter molecule activatable by the capture antibody is then added to each well. The plate is covered and incubated at room temperature for 30 minutes. The plate is then aspirated and washed 4 times using wash buffer. The reaction is stopped by adding stop solution. The absorbance of each well in the plate is read at 450 nm, and the concentration of histones in each sample is calculated according to the standard curve of absorbance at 450 nm vs. concentration of histone in standard samples.

In some embodiments, fusosome samples will comprise less than 1%, 2%, 3%, 4%, 5%, 10%, 20%, 30%, 40%, 50%, 60%, 70%, 80%, or 90% the histone concentration of the nucleated parental cells.

Example 38: Measuring DNA Content in Fusosomes

This example describes quantification of the amount of DNA in a fusosome relative to nucleated counterparts. In some embodiments, fusosomes will have less DNA than nucleated counterparts. Nucleic acid levels are determined by measuring total DNA or the level of a specific housekeeping gene. In some embodiments, fusosomes having reduced DNA content or substantially lacking DNA will be unable to replicate, differentiate, or transcribe genes, ensuring that their dose and function is not altered when administered to a subject.

Fusosomes are prepared by any one of the methods described in previous Examples. Preparations of the same mass as measured by protein of fusosomes and source cells are used to isolate total DNA (e.g. using a kit such as Qiagen DNeasy catalog #69504), followed by determination of DNA concentration using standard spectroscopic methods to assess light absorbance by DNA (e.g. with Thermo Scientific NanoDrop).

In some embodiments, concentration of DNA in enucleated fusosomes will be less than about 50%, 40%, 30%, 20%, 10%, 5%, 4%, 3%, 2%, 1% or less than in parental cells.

Alternatively, the concentration of a specific house-keeping gene, such as GAPDH, can be compared between nucleated cells and fusosomes with semi-quantitative real-time PCR (RT-PCR). Total DNA is isolated from parental cells and fusosome and DNA concentration is measured as described herein. RT-PCR is carried out with a PCR kit (Applied Biosystems, catalog #4309155) using the following reaction template:

SYBR Green Master Mix: 10 μL 0.45 μM Forward Primer: 1 μL 0.45 μM Reverse Primer: 1 μL DNA Template: 10 ng PCR-Grade Water: Variable Forward and reverse primers are acquired from Integrated DNA Technologies. The table below details the primer pairs and their associated sequences:

TABLE 21

| Primer sequences | | |
|---|---|---|
| Target | Forward Primer Sequence (5'→3') (SEQ ID NO) | Reverse Primer Sequence (5'→3') (SEQ ID NO) |
| Human nDNA (GAPDH) | GGAGTCCACTGGCGTCTTCAC (SEQ ID NO: 598) | GAGGCATTGCTGATGATCTTGAGG (SEQ ID NO: 599) |

A real-time PCR system (Applied Biosystems) is used to perform the amplification and detection with the following protocol:

| | |
|---|---|
| Denaturation, 94° C. | 2 min |
| 40 Cycles of the following sequence: | |
| Denaturation, 94° C. | 15 sec |
| Annealing, Extension, 60° C. | 1 min |

A standard curve of the $C_t$ vs. DNA concentration is prepared with serial dilutions of GAPDH DNA and used to normalize the Ct nuclear value from fusosome PCR results to a specific amount (ng) of DNA.

In some embodiments, concentration of GAPDH DNA in enucleated fusosomes will be less than about 50%, 40%, 30%, 20%, 10%, 5%, 4%, 3%, 2%, 1% or less than in parental cells.

Example 39: Measuring miRNA Content in Fusosomes

This example describes quantification of microRNAs (miRNAs) in fusosomes. In some embodiments, a fusosome comprises miRNAs.

MiRNAs are regulatory elements that, among other activities, control the rate by which messenger RNAs (mRNAs) are translated into proteins. In some embodiments, fusosomes carrying miRNA may be used to deliver the miRNA to target sites.

Fusosomes are prepared by any one of the methods described in previous Examples. RNA from fusosomes or parental cells is prepared as described previously. At least one miRNA gene is selected from the Sanger Center miRNA Registry at www.sanger.ac.uk/Software/Rfam/mirna/index.shtml. miRNA is prepared as described in Chen et al, *Nucleic Acids Research,* 33(20), 2005. All TaqMan miRNA assays are available through Thermo Fisher (A25576, Waltham, MA).

qPCR is carried out according to manufacturer's specifications on miRNA cDNA, and $C_T$ values are generated and analyzed using a real-time PCR system as described herein.

In some embodiments, miRNA content of fusosomes will be at least 1%, 2%, 3%, 4%, 5%, 10%, 20%, 30%, 40%, 50%, 60%, 70%, 80%, 90%, or greater than that of their parental cells.

Example 40: Quantifying Expression of an Endogenous RNA or Synthetic RNA in Fusosomes This example describes quantification of levels of endogenous RNA with altered expression, or a synthetic RNA that is expressed in a fusosome.

The fusosome or parental cell is engineered to alter the expression of an endogenous or synthetic RNA that mediates a cellular function to the fusosomes.

Transposase vectors (System Biosciences, Inc.) includes the open reading frame of the Puromycin resistance gene together with an open reading frame of a cloned fragment of a protein agent. The vectors are electroporated into 293 Ts using an electroporator (Amaxa) and a 293T cell line specific nuclear transfection kit (Lonza).

Following selection with puromycin for 3-5 days in DMEM containing 20% Fetal Bovine Serum and 1× Penicillin/Streptomycin, fusosomes are prepared from the stably expressing cell line by any one of the methods described in previous Examples.

Individual fusosomes are isolated and protein agent or RNA per fusosome is quantified as described in a previous Example.

In some embodiments, fusosomes will have at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, or more of the RNA per fusosome.

Example 41: Measuring Lipid Composition in Fusosomes

This Example describes quantification of the lipid composition of fusosomes. In some embodiments, lipid composition of fusosomes is similar to the cells that they are derived from. Lipid composition affects important biophysical parameters of fusosomes and cells, such as size, electrostatic interactions, and colloidal behavior.

The lipid measurements are based on mass spectrometry. Fusosomes are prepared by any one of the methods described in previous Examples.

Mass spectrometry-based lipid analysis is performed at a lipid analysis service (Dresden, Germany) as described (Sampaio, et al., Proc Natl Acad Sci, 2011, Feb. 1; 108(5): 1903-7). Lipids are extracted using a two-step chloroform/methanol procedure (Ejsing, et al., Proc Natl Acad Sci, 2009, Mar. 17; 106(7):2136-41). Samples are spiked with an internal lipid standard mixture of: cardiolipin 16:1/15:0/15:0/15:0 (CL), ceramide 18:1; 2/17:0 (Cer), diacylglycerol 17:0/17:0 (DAG), hexosylceramide 18:1; 2/12:0 (HexCer), lysophosphatidate 17:0 (LPA), lyso-phosphatidylcholine 12:0 (LPC), lyso-phosphatidylethanolamine 17:1 (LPE), lyso-phosphatidylglycerol 17:1 (LPG), lyso-phosphatidylinositol 17:1 (LPI), lyso-phosphatidylserine 17:1 (LPS), phosphatidate 17:0/17:0 (PA), phosphatidylcholine 17:0/17:0 (PC), phosphatidylethanolamine 17:0/17:0 (PE), phosphatidylglycerol 17:0/17:0 (PG), phosphatidylinositol 16:0/16:0 (PI), phosphatidylserine 17:0/17:0 (PS), cholesterol ester 20:0 (CE), sphingomyelin 18:1; 2/12:0; 0 (SM) and triacylglycerol 17:0/17:0/17:0 (TAG).

After extraction, the organic phase is transferred to an infusion plate and dried in a speed vacuum concentrator. The first step dry extract is resuspended in 7.5 mM ammonium acetate in chloroform/methanol/propanol (1:2:4, V:V:V) and the second step dry extract is resuspended in 33% ethanol solution of methylamine in chloroform/methanol (0.003:5:1; V:V:V). All liquid handling steps are performed using a robotic platform for organic solvent with an anti-droplet control feature (Hamilton Robotics) for pipetting.

Samples are analyzed by direct infusion on a mass spectrometer (Thermo Scientific) equipped with an ion source (Advion Biosciences). Samples are analyzed in both positive and negative ion modes with a resolution of Rm/z=200=280000 for MS and Rm/z=200=17500 for tandem MS/MS experiments, in a single acquisition. MS/MS is triggered by an inclusion list encompassing corresponding MS mass ranges scanned in 1 Da increments (Surma, et al., Eur J lipid Sci Technol, 2015, October; 117(10):1540-9). Both MS and MS/MS data are combined to monitor CE, DAG and TAG ions as ammonium adducts; PC, PC O—, as acetate adducts; and CL, PA, PE, PE O—, PG, PI and PS as deprotonated anions. MS only is used to monitor LPA, LPE, LPE O—, LPI and LPS as deprotonated anions; Cer, HexCer, SM, LPC and LPC O— as acetate.

Data are analyzed with in-house developed lipid identification software as described in the following references (Herzog, et al., Genome Biol, 2011, Jan. 19; 12(1):R8; Herzog, et al., PLoS One, 2012, January; 7(1):e29851). Only lipid identifications with a signal-to-noise ratio>5, and a signal intensity 5-fold higher than in corresponding blank samples are considered for further data analysis.

Fusosome lipid composition is compared to parental cells' lipid composition. In some embodiments, fusosomes and parental cells will have a similar lipid composition if >50% of the identified lipids in the parental cells are present in the fusosomes, and of those identified lipids, the level in the fusosome will be >25% of the corresponding lipid level in the parental cell.

Example 42: Measuring Proteomic Composition in Fusosomes

This Example describes quantification of the protein composition of fusosomes. In some embodiments, protein composition of fusosomes will be similar to the cells that they are derived from.

Fusosomes are prepared by any one of the methods described in previous Examples. Fusosomes are resuspended in lysis buffer (7M Urea, 2M Thiourea, 4% (w/v) Chaps in 50 mM Tris pH 8.0) and incubated for 15 minutes at room temperature with occasional vortexing. Mixtures are then lysed by sonication for 5 minutes in an ice bath and spun down for 5 minutes at 13,000 RPM. Protein content is determined by a colorimetric assay (Pierce) and protein of each sample is transferred to a new tube and the volume is equalized with 50 mM Tris pH 8.

Proteins are reduced for 15 minutes at 65 Celsius with 10 mM DTT and alkylated with 15 mM iodoacetamide for 30 minutes at room temperature in the dark. Proteins are precipitated with gradual addition of 6 volumes of cold (−20° Celsius) acetone and incubated overnight at −80° C. Protein pellets are washed 3 times with cold (−20° Celsius) methanol. Proteins are resuspended in 50 mM Tris pH 8.3.

Next, trypsin/lysC is added to the proteins for the first 4 h of digestion at 37 Celsius with agitation. Samples are diluted with 50 mM Tris pH 8 and 0.1% sodium deoxycholate is added with more trypsin/lysC for digestion overnight at 37 Celsius with agitation. Digestion is stopped and sodium deoxycholate is removed by the addition of 2% v/v formic acid. Samples are vortexed and cleared by centrifugation for 1 minute at 13,000 RPM. Peptides are purified by reversed phase solid phase extraction (SPE) and dried down. Samples are reconstituted in 20 µl of 3% DMSO, 0.2% formic acid in water and analyzed by LC-MS.

To have quantitative measurements, a protein standard is also run on the instrument. Standard peptides (Pierce, equimolar, LC-MS grade, #88342) are diluted to 4, 8, 20, 40 and 100 fmol/µL and are analyzed by LC-MS/MS. The average AUC (area under the curve) of the 5 best peptides per protein (3 MS/MS transition/peptide) is calculated for each concentration to generate a standard curve.

Acquisition is performed with a high resolution mass spectrometer (ABSciex, Foster City, CA, USA) equipped with an electrospray interface with a 25 µm iD capillary and coupled with micro-ultrahigh performance liquid chromatography (µUHPLC) (Eksigent, Redwood City, CA, USA). Analysis software is used to control the instrument and for data processing and acquisition. The source voltage is set to 5.2 kV and maintained at 225° C., curtain gas is set at 27 psi, gas one at 12 psi and gas two at 10 psi. Acquisition is performed in Information Dependent Acquisition (IDA) mode for the protein database and in SWATH acquisition mode for the samples. Separation is performed on a reversed phase column 0.3 µm i.d., 2.7 µm particles, 150 mm long (Advance Materials Technology, Wilmington, DE) which is maintained at 60° C. Samples are injected by loop overfilling into a 5 µL loop. For the 120 minute (samples) LC gradient, the mobile phase includes the following: solvent A (0.2% v/v formic acid and 3% DMSO v/v in water) and solvent B (0.2% v/v formic acid and 3% DMSO in EtOH) at a flow rate of 3 µL/min.

For the absolute quantification of the proteins, a standard curve (5 points, R2>0.99) is generated using the sum of the AUC of the 5 best peptides (3 MS/MS ion per peptide) per protein. To generate a database for the analysis of the samples, the DIAUmpire algorithm is run on each of the 12 samples and combined with the output MGF files into one database. This database is used with software (ABSciex) to quantify the proteins in each of the samples, using 5 transition/peptide and 5 peptide/protein maximum. A peptide is considered as adequately measured if the score computed is superior to 1.5 or had a FDR<1%. The sum of the AUC of each of the adequately measured peptides is mapped on the standard curve, and is reported as fmol.

The resulting protein quantification data is then analyzed to determine protein levels and proportions of known classes of proteins as follows: enzymes are identified as proteins that are annotated with an Enzyme Commission (EC) number; ER associated proteins are identified as proteins that had a Gene Ontology (GO; http://www.geneontology.org) cellular compartment classification of ER and not mitochondria; exosome associated proteins are identified as proteins that have a Gene Ontology cellular compartment classification of exosomes and not mitochondria; and mitochondrial proteins are identified as proteins that are identified as mitochondrial in the MitoCarta database (Calvo et al., NAR 20151 doi: 10.1093/nar/gkv1003). The molar ratios of each of these categories are determined as the sum of the molar quantities of all the proteins in each class divided by the sum of the molar quantities of all identified proteins in each sample.

Fusosome proteomic composition is compared to parental cell proteomic composition. In some embodiments, similar proteomic compositions between fusosomes and parental cells will be observed when >50% of the identified proteins are present in the fusosome, and of those identified proteins the level is >25% of the corresponding protein level in the parental cell.

Example 43: Quantifying an Endogenous or Synthetic Protein Level Per Fusosome This example describes quantification of an endogenous or synthetic protein cargo in fusosomes. In some embodiments, fusosomes comprise an endogenous or synthetic protein cargo.

The fusosome or parental cell is engineered to alter the expression of an endogenous protein or express a synthetic cargo that mediates a therapeutic or novel cellular function.

Transposase vectors (System Biosciences, Inc.) that include the open reading frame of the puromycin resistance gene together with an open reading frame of a cloned fragment of a protein agent, optionally translationally fused to the open reading frame of a green fluorescent protein (GFP). The vectors are electroporated into 293 Ts using an electroporator (Amaxa) and a 293T cell line specific nuclear transfection kit (Lonza).

Following selection with puromycin for 3-5 days in DMEM containing 20% fetal bovine serum and 1× penicillin/streptomycin, fusosomes are prepared from the stably expressing cell line by any one of the methods described in previous Examples.

Altered expression levels of an endogenous protein or expression levels of a synthetic protein that are not fused to GFP are quantified by mass spectrometry as described above. In some embodiments, fusosomes will have at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, or more protein agent molecules per fusosome.

Alternatively, purified GFP is serially diluted in DMEM containing 20% fetal bovine serum and 1× Penicillin/Streptomycin to generate a standard curve of protein concentration. GFP fluorescence of the standard curve and a sample of fusosomes is measured in a fluorimeter (BioTek) using a GFP light cube (469/35 excitation filter and a 525/39 emission filter) to calculate the average molar concentration of GFP molecules in the fusosomes. The molar concentration is then converted to number of GFP molecules and divided by the number of fusosomes per sample to achieve an average number of protein agent molecules per fusosome.

In some embodiments, fusosomes will have at least 1, 2, 3, 4, 5, 10, 20, 50, 100, 500, $10^3$, $5.0\times10^3$, $10^4$, $5.0\times10^4$, $10^5$, $5.0\times10^5$, $10^6$, $5.0\times10^6$, or more protein agent molecules per fusosome.

Example 44: Measuring Markers of Exosomal Proteins in Fusosomes

This assay describes quantification of the proteomics makeup of the sample preparation, and quantifies the proportion of proteins that are known to be specific markers of exosomes.

Fusosomes are pelleted and shipped frozen to the proteomics analysis center per standard biological sample handling procedures.

The fusosomes are thawed for protein extraction and analysis. First, they are resuspended in lysis buffer (7M urea, 2M thiourea, 4% (w/v) chaps in 50 mM Tris pH 8.0) and incubated for 15 minutes at room temperature with occasional vortexing. The mixtures are then lysed by sonication for 5 minutes in an ice bath and spun down for 5 minutes at 13,000 RPM. Total protein content is determined by a colorimetric assay (Pierce) and 100 μg of protein from each sample is transferred to a new tube and the volume is adjusted with 50 mM Tris pH 8.

The proteins are reduced for 15 minutes at 65° Celsius with 10 mM DTT and alkylated with 15 mM iodoacetamide for 30 minutes at room temperature in the dark. The proteins are then precipitated with gradual addition of 6 volumes of cold (−20° Celsius) acetone and incubated over night at −80° Celsius.

The proteins are pelleted, washed 3 times with cold (−20° Celsius) methanol, and resuspended in 50 mM Tris pH 8. 3.33 μg of trypsin/lysC is added to the proteins for a first 4 h of digestion at 37° Celsius with agitation. The samples are diluted with 50 mM Tris pH 8 and 0.1% sodium deoxycholate is added with another 3.3 μg of trypsin/lysC for digestion overnight at 37° Celsius with agitation. Digestion is stopped and sodium deoxycholate is removed by the addition of 2% v/v formic acid. Samples are vortexed and cleared by centrifugation for 1 minute at 13,000 RPM.

The proteins are purified by reversed phase solid phase extraction (SPE) and dried down. The samples are reconstituted in 3% DMSO, 0.2% formic acid in water and analyzed by LC-MS as described previously.

The resulting protein quantification data is analyzed to determine protein levels and proportions of know exosomal marker proteins. Specifically: tetraspanin family proteins (CD63, CD9, or CD81), ESCRT-related proteins (TSG101, CHMP4A-B, or VPS4B), Alix, TSG101, MHCI, MHCII, GP96, actinin-4, mitofilin, syntenin-1, TSG101, ADAM10, EHD4, syntenin-1, TSG101, EHD1, flotillin-1, heat-shock 70-kDa proteins (HSC70/HSP73, HSP70/HSP72). The molar ratio these exosomal marker proteins relative to all proteins measured is determined as the molar quantity of each specific exosome marker protein listed above divided by the sum of the molar quantities of all identified proteins in each sample and expressed as a percent.

Similarly, the molar ratio for all exosomal marker proteins relative to all proteins measured is determined as the sum of the molar quantity of all specific exosome marker protein listed above divided by the sum of the molar quantities of all identified proteins in each sample and expressed as a percent of the total.

In some embodiments, a sample will comprise less than 5% of any individual exosomal marker protein and less than 15% of total exosomal marker proteins.

In some embodiments, an individual exosomal marker protein will be present at less than 0.05%, 0.1%, 0.5%, 1%, 2%, 3%, 4%, 5%, or 10%.

In some embodiments, the sum of all exosomal marker proteins will be less than 0.05%, 0.1%, 0.5%, 1%, 2%, 3%, 4%, 5%, 10%, 15%, 20%, or 25%.

Example 45: Measuring GAPDH in Fusosomes

This assay describes quantification of the level of glyceraldehyde 3-phosphate dehydrogenase (GAPDH) in the fusosomes, and the relative level of GAPDH in the fusosomes compared to the parental cells.

GAPDH is measured in the parental cells and the fusosomes using a standard commercially available ELISA for GAPDH (ab176642, Abcam) per the manufacturer's directions.

Total protein levels are similarly measured via bicinchoninic acid assay as previously described in the same volume of sample used to measure GAPDH. In embodiments, using this assay, the level of GAPDH per total protein in the fusosomes will be <100 ng GAPDH/μg total protein. Similarly, in embodiments, the decrease in GAPDH levels relative to total protein from the parental cells to the fusosomes will be greater than a 10% decrease.

In some embodiments, GAPDH content in the preparation in ng GAPDH/μg total protein will be less than 500, less than 250, less than 100, less than 50, less than 20, less than 10, less than 5, or less than 1.

In some embodiments, a decrease in GAPDH per total protein in ng/μg from the parent cell to the preparation will be more than 1%, more than 2.5%, more than 5%, more than 10%, more than 15%, more than 20%, more than 30%, more than 40%, more than 50%, more than 60%, more than 70%, more than 80%, or more than 90%.

Example 46: Measuring Calnexin in Fusosomes

This assay describes quantification of the level of calnexin (CNX) in the fusosomes, and the relative level of CNX in the fusosomes compared to the parental cells.

Calnexin is measured in the starting cells and the preparation using a standard commercially available ELISA for calnexin (MBS721668, MyBioSource) per the manufacturer's directions.

Total protein levels are similarly measured via bicinchoninic acid assay as previously described in the same volume of sample used to measure calnexin. In embodiments, using this assay, the level of calnexin per total protein in the fusosomes will be <100 ng calnexin/μg total protein. Similarly, in embodiments, the increase in calnexin levels relative to total protein from the parental cell to the fusosomes will be greater than a 10% increase.

In some embodiments, calnexin content in the preparation in ng calnexin/μg total protein will be less than 500, 250, 100, 50, 20, 10, 5, or 1.

In some embodiments, a decrease in calnexin per total protein in ng/μg from the parent cell to the preparation will be more than 1%, 2.5%, 5%, 10%, 15%, 20%, 30%, 40%, 50%, 60%, 70%, 80%, or 90%.

Example 47: Comparison of Soluble to Insoluble Protein Mass

This Example describes quantification of the soluble: insoluble ratio of protein mass in fusosomes. In some embodiments, a soluble:insoluble ratio of protein mass in fusosomes will be similar to nucleated cells.

Fusosomes are prepared by any one of the methods described in previous Examples. The fusosome preparation is tested to determine the soluble:insoluble protein ratio using a standard bicinchoninic acid assay (BCA) (e.g. using the commercially available Pierce™ BCA Protein Assay Kit, Thermo Fischer product #23225). Soluble protein samples are prepared by suspending the prepared fusosomes or parental cells at a concentration of $1\times10^7$ cells or fusosomes/mL in PBS and centrifuging at 1600 g to pellet the fusosomes or cells. The supernatant is collected as the soluble protein fraction.

The fusosomes or cells in the pellet are lysed by vigorous pipetting and vortexing in PBS with 2% Triton-X-100. The lysed fraction represents the insoluble protein fraction.

A standard curve is generated using the supplied BSA, from 0 to 20 μg of BSA per well (in triplicate). The fusosome or cell preparation is diluted such that the quantity measured is within the range of the standards. The fusosome preparation is analyzed in triplicate and the mean value is used. The soluble protein concentration is divided by the insoluble protein concentration to yield the soluble:insoluble protein ratio.

In some embodiments, a fusosome soluble:insoluble protein ratio will be within 1%, 2%, 3%, 4%, 5%, 10%, 20%, 30%, 40%, 50%, 60%, 70%, 80%, 90%, or greater compared to the parental cells.

Example 48: Measuring LPS in Fusosomes

This example describes quantification of levels of lipopolysaccharides (LPS) in fusosomes as compared to parental cells. In some embodiments, fusosomes will have lower levels of LPS compared to parental cells.

LPS are a component of bacterial membranes and potent inducer of innate immune responses.

The LPS measurements are based on mass spectrometry as described in the previous Examples.

In some embodiments, less than 5%, 1%, 0.5%, 0.01%, 0.005%, 0.0001%, 0.00001% or less of the lipid content of fusosomes will be LPS.

Example 49: Ratio of Lipids to Proteins in Fusosomes

This Example describes quantification of the ratio of lipid mass to protein mass in fusosomes. In some embodiments, fusosomes will have a ratio of lipid mass to protein mass that is similar to nucleated cells.

Total lipid content is calculated as the sum of the molar content of all lipids identified in the lipidomics data set outlined in a previous Example. Total protein content of the fusosomes is measured via bicinchoninic acid assay as described herein.

Alternatively, the ratio of lipids to proteins can be described as a ratio of a particular lipid species to a specific protein. The particular lipid species is selected from the lipidomics data produced in a previous Example. The specific protein is selected from the proteomics data produced in a previous Example. Different combinations of selected lipid species and proteins are used to define specific lipid: protein ratios.

Example 50: Ratio of Proteins to DNA in Fusosomes

This Example describes quantification of the ratio of protein mass to DNA mass in fusosomes. In some embodiments, fusosomes will have a ratio of protein mass to DNA mass that is much greater than cells.

Total protein content of the fusosomes and cells is measured as described in in a previous Example. The DNA mass of fusosomes and cells is measured as described in a previous Example. The ratio of proteins to total nucleic acids is then determined by dividing the total protein content by the total DNA content to yield a ratio within a given range for a typical fusosome preparation.

Alternatively, the ratio of proteins to nucleic acids is determined by defining nucleic acid levels as the level of a specific house-keeping gene, such as GAPDH, using semi-quantitative real-time PCR (RT-PCR).

The ratio of proteins to GAPDH nucleic acids is then determined by dividing the total protein content by the total GAPDH DNA content to define a specific range of protein: nucleic acid ratio for a typical fusosome preparation.

Example 51: Ratio of Lipids to DNA in Fusosomes

This Example describes quantification of the ratio of lipids to DNA in fusosomes compared to parental cells. In some embodiments, fusosomes will have a greater ratio of lipids to DNA compared to parental cells.

This ratio is defined as total lipid content (outlined in an Example above) or a particular lipid species. In the case of a particular lipid species, the range depends upon the particular lipid species selected. The particular lipid species is selected from the lipidomics data produced in the previously described Example. Nucleic acid content is determined as described in the previously described Example.

Different combinations of selected lipid species normalized to nucleic acid content are used to define specific lipid:nucleic acid ratios that are characteristic of a particular fusosome preparation.

Example 52: Analyzing Surface Markers on Fusosomes

This assay describes identification of surface markers on the fusosomes.

Fusosomes are pelleted and shipped frozen to the proteomics analysis center per standard biological sample handling procedures.

To identify surface marker presence or absence on the fusosomes, they are stained with markers against phosphatidyl serine and CD40 ligand and analyzed by flow cytometry using a FACS system (Becton Dickinson). For detection of surface phosphatidylserine, the product is analyzed with an annexin V assay (556547, BD Biosciences) as described by the manufacturer.

Briefly, the fusosomes are washed twice with cold PBS and then resuspended in 1× binding buffer at a concentration of $1\times10^6$ fusosomes/mL. 10% of the resuspension is transferred to a 5 mL culture tube and 5 μl of FITC annexin V is added. The cells are gently vortexed and incubated for 15 min at room temperature (25° C.) in the dark.

In parallel, a separate 10% of the resuspension is transferred to a different tube to act as an unstained control. 1× binding buffer is added to each tube. The samples are analyzed by flow cytometry within 1 hr.

In some embodiments, using this assay, the mean of the population of the stained fusosomes will be determined to be above the mean of the unstained cells indicating that the fusosomes comprise phosphatidyl serine.

Similarly, for the CD40 ligand, the following monoclonal antibody is added to another 10% of the washed fusosomes: PE-CF594 mouse anti-human CD154 clone TRAP1 (563589, BD Pharmigen) as per the manufacturer's directions. Briefly, saturating amounts of the antibody are used. In parallel, a separate 10% of the fusosomes are transferred to a different tube to act as an unstained control. The tubes are centrifuged for 5 min at 400×g, at room temperature. The supernatant is decanted and the pellet is washed twice with flow cytometry wash solution. 0.5 mL of 1% paraformaldehyde fixative is added to each tube. Each is briefly vortexed and stored at 4° C. until analysis on the flow cytometer.

In some embodiments, using this assay or equivalent, the mean of the population of the stained fusosomes will be above the mean of the unstained cells indicating that the fusosomes comprise CD40 ligand.

Example 53: Analysis of Viral Capsid Proteins in Fusosomes

This assay describes analysis of the makeup of the sample preparation and assesses the proportion of proteins that are derived from viral capsid sources.

Fusosomes are pelleted and shipped frozen to a proteomics analysis center per standard biological sample handling procedures.

The fusosomes are thawed for protein extraction and analysis. First, they are resuspended in lysis buffer (7M urea, 2M thiourea, 4% (w/v) chaps in 50 mM Tris pH 8.0) and incubated for 15 minutes at room temperature with occasional vortexing. The mixtures are then lysed by sonication for 5 minutes in an ice bath and spun down for 5 minutes at 13,000 RPM. Total protein content is determined by a colorimetric assay (Pierce) and 100 μg of protein from each sample is transferred to a new tube and the volume is adjusted with 50 mM Tris pH 8.

The proteins are reduced for 15 minutes at 65° Celsius with 10 mM DTT and alkylated with 15 mM iodoacetamide for 30 minutes at room temperature in the dark. The proteins are then precipitated with gradual addition of 6 volumes of cold (−20° Celsius) acetone and incubated over night at −80° Celsius.

The proteins are pelleted, washed 3 times with cold (−20° Celsius) methanol, and resuspended in 50 mM Tris pH 8. 3.33 μg of trypsin/lysC is added to the proteins for a first 4 h of digestion at 37° Celsius with agitation. The samples are diluted with 50 mM Tris pH 8 and 0.1% sodium deoxycholate is added with another 3.3 μg of trypsin/lysC for digestion overnight at 37° Celsius with agitation. Digestion is stopped and sodium deoxycholate is removed by the addition of 2% v/v formic acid. Samples are vortexed and cleared by centrifugation for 1 minute at 13,000 RPM.

The proteins are purified by reversed phase solid phase extraction (SPE) and dried down. The samples are reconstituted in 3% DMSO, 0.2% formic acid in water and analyzed by LC-MS as described previously.

The molar ratio of the viral capsid proteins relative to all proteins measured is determined as the molar quantity of all viral capsid proteins divided by the sum of the molar quantities of all identified proteins in each sample and expressed as a percent.

In some embodiments, using this approach or an equivalent, the sample will comprise less than 10% viral capsid protein. In some embodiments, a sample will comprise less than 0.5%, 1%, 5%, 10%, 15%, 20%, 25%, 30%, 35%, 40%, 45%, 50%, 60%, 70%, 80%, or 90% viral capsid protein.

Example 54: Measuring Fusion with a Target Cell

This example describes quantification of fusosome fusion with a target cell compared to a non-target cell.

In some embodiments, fusosome fusion with a target cell allows the cell-specific delivery of a cargo, carried within the lumen of the fusosome, to the cytosol of the recipient cell. Fusosomes produced by the herein described methods are assayed for fusion rate with a target cell as follows.

In this example, the fusosome comprises a HEK293T cell expressing Myomaker on its plasma membrane. In addition, the fusosome expresses mTagBFP2 fluorescent protein and Cre recombinase. The target cell is a myoblast cell, which expresses both Myomaker and Myomixer, and the non-target cell is a fibroblast cell, which expresses neither Myomaker nor Myomixer. A Myomaker-expressing fusosome is predicted to fuse with the target cell that expresses both Myomaker and Myomixer but not the non-target cell (Quinn et al., 2017, Nature Communications, 8, 15665. doi.org/10.1038/ncomms15665) (Millay et al., 2013, Nature, 499(7458), 301-305. doi.org/10.1038/nature12343). Both the target and non-target cell types are isolated from mice and stably-express "LoxP-stop-Loxp-tdTomato" cassette under a CMV promoter, which upon recombination by Cre turns on tdTomato expression, indicating fusion.

The target or non-target recipient cells are plated into a black, clear-bottom 96-well plate. Both target and non-target cells are plated for the different fusion groups. Next, 24 hours after plating the recipient cells, the fusosomes expressing Cre recombinase protein and Myomaker are applied to the target or non-target recipient cells in DMEM media. The dose of fusosomes is correlated to the number of recipient cells plated in the well. After applying the fusosomes, the cell plate is centrifuged at 400 g for 5 minutes to help initiate contact between the fusosomes and the recipient cells.

Starting at four hours after fusosome application, the cell wells are imaged to positively identify RFP-positive cells versus GFP-positive cells in the field or well.

In this example, cell plates are imaged using an automated microscope (www.biotek.com/products/imaging-microscopy-automated-cell-imagers/lionheart-fx-automated-live-cell-imager/). The total cell population in a given well is determined by first staining the cells with Hoechst 33342 in DMEM media for 10 minutes. Hoechst 33342 stains cell nuclei by intercalating into DNA and therefore is used to identify individual cells. After staining, the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of target and non-target cell wells are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings. Wells are imaged every 4 hours to acquire time-course data for rates of fusion activity.

Analysis of GFP and RFP-positive wells is performed with software provided with the fluorescent microscope or other software (Rasband, W. S., ImageJ, U. S. National Institutes of Health, Bethesda, Maryland, USA, rsb.info.nih.gov/ij/, 1997-2007).

The images are pre-processed using a rolling ball background subtraction algorithm with a 60 μm width. The total cell mask is set on the Hoechst-positive cells. Cells with Hoechst intensity significantly above background intensities are thresholded and areas too small or large to be Hoechst-positive cells are excluded.

Within the total cell mask, GFP and RFP-positive cells are identified by again thresholding for cells significantly above background and extending the Hoechst (nuclei) masks for the entire cell area to include the entire GFP and RFP cellular fluorescence. The number of RFP-positive cells identified in control wells containing target or non-target recipient cells is used to subtract from the number of RFP-positive cells in the wells containing fusosome (to subtract for non-specific Loxp recombination). The number of RFP-positive cells (fused recipient cells) is then divided by the sum of the GFP-positive cells (recipient cells that have not fused) and RFP-positive cells at each time point to quantify the rate of fusosome fusion within the recipient cell population. The rate is normalized to the given dose of fusosome applied to the recipient cells. For rates of targeted fusion (fusosome fusion to targeted cells), the rate of fusion to the non-target cell is subtracted from the rate of fusion to the target cell in order to quantify rates of targeted fusion.

In some embodiments, average rate of fusion for the fusosomes with the target cells will be in the range of 0.01-4.0 RFP/GFP cells per hour for target cell fusion or at least 1%, 2%, 3%, 4%, 5%, 10%, 20%, 30%, 40%, 50%, 60%, 70%, 80%, 90% or greater than non-target recipient cells with fusosomes. In some embodiments, groups with no fusosome applied will show a background rate of <0.01 RFP/GFP cells per hour.

Example 55: In Vitro Fusion to Deliver a Membrane Protein

This example describes fusosome fusion with a cell in vitro. In some embodiments, fusosome fusion with a cell in vitro results in delivery of an active membrane protein to the recipient cell.

In this example, the fusosomes are generated from a HEK293T cell expressing the Sendai virus HVJ-E protein (Tanaka et al., 2015, Gene Therapy, 22 (October 2014), 1-8. doi.org/10.1038/gt.2014.12). In some embodiments, fusosomes are generated to express the membrane protein, GLUT4, which is found primarily in muscle and fat tissues and is responsible for the insulin-regulated transport of glucose into cells. Fusosomes with and without GLUT4 are prepared from HEK293T cells as described by any of the methods described in a previous Example.

Muscles cells, such as, C2C12 cells, are then treated with fusosomes expressing GLUT4, fusosomes that do not express GLUT4, PBS (negative control), or insulin (positive control). The activity of GLUT4 on C2C12 cells is measured by the uptake of the fluorescent 2-deoxyglucose analog, 2-[N-(7-nitrobenz-2-oxa-1,3-diaxol-4-yl)amino]-2-deoxy-glucose (2-NBDG). The fluorescence of C2C12 cells is assessed via microscopy using methods described in previous Examples.

In some embodiments, C2C12 cells that are treated with fusosomes that express GLUT4 and insulin are expected to demonstrate increased fluorescence compared to C2C12 cells treated with PBS or fusosomes not expressing GLUT4. See, also, Yang et al., Advanced Materials 29, 1605604, 2017.

Example 56: In Vivo Delivery of Membrane Protein

This example describes fusosome fusion with a cell in vivo. In some embodiments, fusosome fusion with a cell in vivo results in delivery of an active membrane protein to the recipient cell.

In this example, the fusosomes are generated from a HEK293T cell expressing the Sendai virus HVJ-E protein as in the previous Example. In some embodiments, fusosomes are generated to express the membrane protein, GLUT4. Fusosomes with and without GLUT4 are prepared from HEK293T cells as described by any of the methods described in a previous Example.

BALB/c-nu mice are administered fusosomes expressing GLUT4, fusosomes that do not express GLUT4, or PBS (negative control). Mice are injected intramuscularly in the tibialis anterior muscle with fusosomes or PBS. Immediately prior to fusosome administration, mice are fasted for 12 hours and injected with [18F] 2-fluoro-2deoxy-d-glucose (18F-FDG), which is an analog of glucose that enables positron emission tomography (PET imaging). Mice are injected with 18F-FDG via the tail vein under anesthesia (2% isoflurane). PET imaging is performed using a nanoscale imaging system (1T, Mediso, Hungary). Imaging is conducted 4 hours after administration of fusosomes. Immediately after imaging, mice are sacrificed and the tibialis anterior muscle is weighed. PET images are reconstructed using a 3D imaging system in full detector mode, with all corrections on, high regularization, and eight iterations. Three-dimensional volume of interest (VOI) analysis of the reconstructed images is performed using the imaging software package (Mediso, Hungary) and applying standard uptake value (SUV) analysis. VOI fixed with a diameter of 2 mm sphere, is drawn for the tibialis anterior muscle site. The SUV of each VOI sites is calculated using the following formula: SUV=(radioactivity in volume of interest, measured as Bq/cc×body weight)/injected radioactivity.

In some embodiments, mice that are administered fusosomes expressing GLUT4 are expected to demonstrate an increased radioactive signal in VOI as compared to mice administered PBS or fusosomes that do not express GLUT4. See, also, Yang et al., Advanced Materials 29, 1605604, 2017.

Example 57: Measuring Extravasation from Blood Vessels

This Example describes quantification of fusosome extravasation across an endothelial monolayer as tested with an in vitro microfluidic system (J. S Joen et al. 2013, journals.plos.org/plosone/article?id=10.1371/journal-.pone.0056910).

Cells extravasate from the vasculature into surrounding tissue. Without wishing to be bound by theory, extravasation is one way for fusosomes to reach extravascular tissues.

The system includes three independently addressable media channels, separated by chambers into which an ECM-mimicking gel can be injected. In brief, the microfluidics system has molded PDMS (poly-dimethyl siloxane; Silgard 184; Dow Chemical, MI) through which access ports are bored and bonded to a cover glass to form microfluidic channels. Channel cross-sectional dimensions are 1 mm (width) by 120 μm (height). To enhance matrix adhesion, the PDMS channels are coated with a PDL (poly-D-lysine hydrobromide; 1 mg/mL; Sigma-Aldrich, St. Louis, MO) solution.

Next, collagen type I (BD Biosciences, San Jose, CA, USA) solution (2.0 mg/mL) with phosphate-buffered saline (PBS; Gibco) and NaOH is injected into the gel regions of the device via four separate filling ports and incubated for 30 min to form a hydrogel. When the gel is polymerized, endothelial cell medium (acquired from suppliers such as Lonza or Sigma) is immediately pipetted into the channels to prevent dehydration of the gel. Upon aspirating the medium, diluted hydrogel (BD science) solution (3.0 mg/mL) is introduced into the cell channel and the excess hydrogel solution is washed away using cold medium.

Endothelial cells are introduced into the middle channel and allowed to settle to form an endothelium. Two days after endothelial cell seeding, fusosomes or macrophage cells (positive control) are introduced into the same channel where endothelial cells had formed a complete monolayer. The fusosomes are introduced so they adhere to and transmigrate across the monolayer into the gel region. Cultures are kept in a humidified incubator at 37° C. and 5% CO2. A GFP-expressing version of the fusosome is used to enable live-cell imaging via fluorescent microscopy. On the following day, cells are fixed and stained for nuclei using DAPI staining in the chamber, and multiple regions of interest are imaged using confocal microscope to determine how many fusosomes passed through the endothelial monolayer.

In some embodiments, DAPI staining will indicate that fusosomes and positive control cells are able to pass through the endothelial barrier after seeding.

Example 58: Measuring Chemotactic Cell Mobility

This Example describes quantification of fusosome chemotaxis. Cells can move towards or away from a chemical gradient via chemotaxis. In some embodiments, chemotaxis will allow fusosomes to home to a site of injury, or track a pathogen. A purified fusosome composition as produced by any one of the methods described in previous Examples is assayed for its chemotactic abilities as follows.

A sufficient number of fusosomes or macrophage cells (positive control) are loaded in a micro-slide well according to the manufacturer's provided protocol in DMEM media (ibidi.com/img/cms/products/labware/channel_slides/S_8032X_Chemotaxis/IN_8032X_Chemot axis.pdf). Fusosomes are left at 37° C. and 5% $CO_2$ for 1 h to attach. Following cell attachment, DMEM (negative control) or DMEM containing MCP1 chemoattractant is loaded into adjacent reservoirs of the central channel and the fusosomes are imaged continuously for 2 hours using a Zeiss inverted widefield microscope. Images are analyzed using ImageJ software (Rasband, W. S., ImageJ, U. S. National Institutes of Health, Bethesda, Maryland, USA, http://rsb.info.nih-.gov/ij/, 1997-2007). Migration co-ordination data for each observed fusosome or cell is acquired with the manual tracking plugin (Fabrice Cordelières, Institut Curie, Orsay, France). Chemotaxis plots and migration velocities is determined with the Chemotaxis and Migration Tool (ibidi).

In some embodiments, an average accumulated distance and migration velocity of fusosomes will be within 1%, 2%, 3%, 4%, 5%, 10%, 20%, 30%, 40%, 50%, 60%, 70%, 80%, 90%, 100% or greater than the response of the positive control cells to chemokine. The response of cells to a chemokine is described, e.g., in Howard E. Gendelman et al., *Journal of Neuroimmune Pharmacology,* 4(1): 47-59, 2009.

Example 59: Measuring Homing Potential

This Example describes homing of fusosomes to a site of injury. Cells can migrate from a distal site and/or accumulate at a specific site, e.g., home to a site. Typically, the site is a site of injury. In some embodiments, fusosomes will home to, e.g., migrate to or accumulate at, a site of injury.

Eight week old C57BL/6J mice (Jackson Laboratories) are dosed with notexin (NTX) (Accurate Chemical & Scientific Corp), a myotoxin, in sterile saline by intramuscular (IM) injection using a 30G needle into the right tibialis anterior (TA) muscle at a concentration of 2 μg/mL. The skin over the tibialis anterior (TA) muscle is prepared by depilating the area using a chemical hair remover for 45 seconds, followed by 3 rinses with water. This concentration is chosen to ensure maximum degeneration of the myofibers, as well as minimal damage to their satellite cells, the motor axons and the blood vessels.

On day 1 after NTX injection, mice receive an IV injection of fusosomes or cells that express firefly luciferase. Fusosomes are produced from cells that stably express firefly luciferase by any one of the methods described in previous Examples. A bioluminescent imaging system (Perkin Elmer) is used to obtain whole animal images of bioluminescence at 0, 1, 3, 7, 21, and 28 post injection.

Five minutes before imaging, mice receive an intraperitoneal injection of bioluminescent substrate (Perkin Elmer) at a dose of 150 mg/kg in order to visualize luciferase. The imaging system is calibrated to compensate for all device settings. The bioluminescent signal is measured using Radiance Photons, with Total Flux used as a measured value. The region of interest (ROI) is generated by surrounding the signal of the ROI in order to give a value in photons/second. An ROI is assessed on both the TA muscle treated with NTX and on the contralateral TA muscle, and the ratio of photons/ second between NTX-treated and NTX-untreated TA muscles is calculated as a measure of homing to the NTX-treated muscle.

In some embodiments, a ratio of photons/second between NTX-treated and NTX-untreated TA muscles in fusosomes and cells will be greater than 1 indicating site specific accumulation of luciferase-expressing fusosomes at the injury.

See, for example, Plant et al., *Muscle Nerve* 34(5)L 577-85, 2006.

Example 60: Measuring Phagocytic Activity

This Example demonstrates phagocytic activity of fusosomes. In some embodiments, fusosomes have phagocytic activity, e.g., are capable of phagocytosis. Cells engage in phagocytosis, engulfing particles, enabling the sequestration and destruction of foreign invaders, like bacteria or dead cells.

A purified fusosome composition as produced by any one of the methods described in previous Examples comprising a fusosome from a mammalian macrophage having partial or complete nuclear inactivation was capable of phagocytosis assayed via pathogen bioparticles. This estimation was made by using a fluorescent phagocytosis assay according to the following protocol.

Macrophages (positive control) and fusosomes were plated immediately after harvest in separate confocal glass bottom dishes. The macrophages and fusosomes were incubated in DMEM+10% FBS+1% P/S for 1 h to attach. Fluorescein-labeled *E. coli* K12 and non-fluorescein-labeled *Escherichia coli* K-12 (negative control) were added to the macrophages/fusosomes as indicated in the manufacturer's protocol, and were incubated for 2 h, tools.thermofisher.com/content/sfs/manuals/mp06694.pdf. After 2 h, free fluorescent particles were quenched by adding Trypan blue. Intracellular fluorescence emitted by engulfed particles was imaged by confocal microscopy at 488 excitation. The number of phagocytotic positive fusosome were quantified using image J software.

The average number of phagocytotic fusosomes was at least 30% 2 h after bioparticle introduction, and was greater than 30% in the positive control macrophages.

Example 61: Measuring Ability to Cross a Cell Membrane or the Blood Brain Barrier This Example describes quantification of fusosomes crossing the blood brain barrier. In some embodiments, fusosomes will cross, e.g., enter and exit, the blood brain barrier, e.g., for delivery to the central nervous system.

Eight week old C57BL/6J mice (Jackson Laboratories) are intravenously injected with fusosomes or leukocytes (positive control) that express firefly luciferase. Fusosomes are produced from cells that stably express firefly luciferase or cells that do not express luciferase (negative control) by any one of the methods described in previous Examples. A bioluminescent imaging system (Perkin Elmer) is used to obtain whole-animal images of bioluminescence at one, two, three, four, five, six, eight, twelve, and twenty-four hours after fusosome or cell injection.

Five minutes before imaging, mice receive an intraperitoneal injection of bioluminescent substrate (Perkin Elmer) at a dose of 150 mg/kg in order to visualize luciferase. The imaging system is calibrated to compensate for all device settings. The bioluminescent signal is measured, with total flux used as a measured value. The region of interest (ROI) is generated by surrounding the signal of the ROI in order to give a value in photons/second. The ROI selected is the head of the mouse around the area that includes the brain.

In some embodiments, the photons/second in the ROI will be greater in the animals injected with cells or fusosomes that express luciferase than the negative control fusosomes that do not express luciferase indicating accumulation of luciferase-expressing fusosomes in or around the brain.

Example 62: Measuring Potential for Protein Secretion

This Example describes quantification of secretion by fusosomes. In some embodiments, fusosomes will be capable of secretion, e.g., protein secretion. Cells can dispose or discharge of material via secretion. In some embodiments, fusosomes will chemically interact and communicate in their environment via secretion.

The capacity of fusosomes to secrete a protein at a given rate is determined using the *Gaussia* luciferase flash assay from ThermoFisher Scientific (catalog #16158). Mouse embryonic fibroblast cells (positive control) or fusosomes as produced by any one of the methods described in previous Examples are incubated in growth media and samples of the media are collected every 15 minutes by first pelleting the fusosomes at 1600 g for 5 min and then collecting the supernatant. The collected samples are pipetted into a clear-bottom 96-well plate. A working solution of assay buffer is then prepared according to the manufacturer's instructions.

Briefly, colenterazine, a luciferin or light-emitting molecule, is mixed with flash assay buffer and the mixture is pipetted into each well of the 96 well plate containing samples. Negative control wells that lack cells or fusosomes include growth media or assay buffer to determine background *Gaussia* luciferase signal. In addition, a standard curve of purified *Gaussia* luciferase (Athena Enzyme Systems, catalog #0308) is prepared in order to convert the luminescence signal to molecules of *Gaussia* luciferase secretion per hour.

The plate is assayed for luminescence, using 500 msec integration. Background *Gaussia* luciferase signal is subtracted from all samples and then a linear best-fit curve is calculated for the *Gaussia* luciferase standard curve. If sample readings do not fit within the standard curve, they are diluted appropriately and re-assayed. Using this assay, the capacity for fusosomes to secrete *Gaussia* luciferase at a rate (molecules/hour) within a given range is determined.

In some embodiments, fusosomes will be capable of secreting proteins at a rate that is 1%, 2%, 3%, 4%, 5%, 10%, 20%, 30%, 40%, 50%, 60%, 70%, 80%, 90%, 100% or greater than the positive control cells.

Example 63: Measuring Signal Transduction Potential

This Example describes quantification of signal transduction in fusosomes. In some embodiments, fusosomes are capable of signal transduction. Cells can send and receive molecular signals from the extracellular environment through signaling cascades, such as phosphorylation, in a process known as signal transduction. A purified fusosome composition as produced by any one of the methods described in previous Examples comprising a fusosome from a mammalian cell having partial or complete nuclear inactivation is capable of signal transduction induced by insulin. Signal transduction induced by insulin is assessed by measuring AKT phosphorylation levels, a key pathway in the insulin receptor signaling cascade, and glucose uptake in response to insulin.

To measure AKT phosphorylation, cells, e.g., Mouse Embryonic Fibroblasts (MEFs) (positive control), and fusosomes are plated in 48-well plates and left for 2 hours in a humidified incubator at 37° C. and 5% CO2. Following cell adherence, insulin (e.g. at 10 nM), or a negative control solution without insulin, is add to the well containing cells or fusosomes for 30 min. After 30 minutes, protein lysate is made from the fusosomes or cells, and phospho-AKT levels are measured by western blotting in insulin stimulated and control unstimulated samples.

Glucose uptake in response to insulin or negative control solution is measured as it is explained in the glucose uptake section by using labeled glucose (2-NBDG). (S. Galic et al., *Molecular Cell Biology* 25(2): 819-829, 2005).

In some embodiments, fusosomes will enhance AKT phosphorylation and glucose uptake in response to insulin over the negative controls by at least 1%, 2%, 3%, 4%, 5%, 10%, 20%, 30%, 40%, 50%, 60%, 70%, 80%, 90%, 100% or greater.

Example 64: Measuring Ability to Transport Glucose Across Cell Membrane

This Example describes quantification of the levels of a 2-NBDG (2-(N-(7-Nitrobenz-2-oxa-1,3-diazol-4-yl) Amino)-2-Deoxyglucose) a fluorescent glucose analog that can be used to monitor glucose uptake in live cells, and thus measure active transport across the lipid bilayer. In some embodiments, this assay or an equivalent can be used to measure the level of glucose uptake and active transport across the lipid bilayer of the fusosome.

A fusosome composition is produced by any one of the methods described in previous Examples. A sufficient number of fusosomes are then incubated in DMEM with no glucose, 20% Fetal Bovine Serum and 1× Penicillin/Streptomycin for 2 hr at 37° C. and 5% $CO_2$. After a 2 hr glucose starvation period, the medium is changed such that it includes DMEM with no glucose, 20% Fetal Bovine Serum, 1× Penicillin/Streptomycin and 20 μM 2-NBDG (ThermoFisher) and incubated for an additional 2 hr at 37° C. and 5% $CO_2$.

Negative control fusosomes are treated the same, except an equal amount of DMSO is added in place of 2-NBDG.

The fusosomes are then washed thrice with 1×PBS and re-suspended in an appropriate buffer, and transferred to a 96 well imaging plate. 2-NBDG fluorescence is then measured in a fluorimeter using a GFP light cube (469/35 excitation filter and a 525/39 emission filter) to quantify the amount of 2-NBDG that has been transported across the fusosome membrane and accumulated in the fusosome in the 1 hr loading period.

In some embodiments, 2-NBDG fluorescence will be higher in the fusosome with 2-NBDG treatment as compared to the negative (DMSO) control. Fluorescence measure with a 525/39 emission filter will correlate with to the number of 2-NBDG molecules present.

Example 65: Lumen of Fusosomes are Miscible with Aqueous Solutions

This example assesses the miscibility of a fusosome lumen with aqueous solutions, such as water.

The fusosomes are prepared as described in previous Examples. The controls are dialysis membranes with either hypotonic solution, hyperosmotic solution or normal osmotic solutions.

Fusosomes, positive control (normal osmotic solution) and negative control (hypotonic solution) are incubated with hypotonic solution (150 mOsmol). The cell size is measured under a microscope after exposing each sample to the aqueous solution. In some embodiments, fusosome and positive control sizes in the hypotonic solution increase in comparison to a negative control.

Fusosomes, positive control (normal osmotic solution) and negative control (hyperosmotic solution) are incubated with a hyperosmotic solution (400 mOsmol). The cell size is measured under a microscope after exposing each sample to the aqueous solution. In some embodiments, fusosome and positive control sizes in a hyperosmotic solution will decrease in comparison to the negative control.

Fusosomes, positive control (hypotonic or hyperosmotic solution) and negative control (normal osmotic) are incubated with a normal osmotic solution (290 mOsmol). The cell size is measured under a microscope after exposing each sample to the aqueous solution. In some embodiments, fusosome and positive control sizes in a normal osmotic solution will remain substantially the same in comparison to the negative control.

Example 66: Measuring Esterase Activity in the Cytosol

This Example describes quantification of esterase activity, as a surrogate for metabolic activity, in fusosomes. The cytosolic esterase activity in fusosomes is determined by quantitative assessment of calcein-AM staining (Bratosin et al., Cytometry 66(1): 78-84, 2005).

The membrane-permeable dye, calcein-AM (Molecular Probes, Eugene OR USA), is prepared as a stock solution of 10 mM in dimethylsulfoxide and as a working solution of 100 mM in PBS buffer, pH 7.4. Fusosomes as produced by any one of the methods described in previous Examples or positive control parental Mouse Embryonic Fibroblast cells are suspended in PBS buffer and incubated for 30 minutes with calcein-AM working solution (final concentration in calcein-AM: 5 mM) at 37° C. in the dark and then diluted in PBS buffer for immediate flow cytometric analysis of calcein fluorescence retention.

Fusosomes and control parental Mouse Embryonic Fibroblast cells are experimental permeabilized as a negative control for zero esterase activity with saponin as described in (Jacob et al., *Cytometry* 12(6): 550-558, 1991). Fusosomes and cells are incubated for 15 min in 1% saponin solution in PBS buffer, pH 7.4, containing 0.05% sodium azide. Due to the reversible nature of plasma membrane permeabilization, saponin is included in all buffers used for further staining and washing steps. After saponin permeabilization, fusosomes and cells are suspended in PBS buffer containing 0.1% saponin and 0.05% sodium azide and incubated (37° C. in the dark for 45 min) with calcein-AM to a final concentration of 5 mM, washed three times with the same PBS buffer containing 0.1% saponin and 0.05% sodium azide, and analyzed by flow cytometry. Flow cytometric analyses are performed on a FACS cytometer (Becton Dickinson, San Jose, CA, USA) with 488 nm argon laser excitation and emission is collected at 530+/−30 nm. FACS software is used for acquisition and analysis. The light scatter channels are set on linear gains, and the fluorescence channels are set on a logarithmic scale, with a minimum of 10,000 cells analyzed in each condition. Relative esterase activities are calculated based on the intensity of calcein-AM in each sample. All events are captured in the forward and side scatter channels (alternatively, a gate can be applied to select only the fusosome population). The fluorescence intensity (FI) value for the fusosomes is determined by subtracting the FI value of the respective negative control saponin-treated sample. The normalized esterase activity for the fusosomes samples are normalized to the respective positive control cell samples in order to generate quantitative measurements for cytosolic esterase activities.

In some embodiments, a fusosome preparation will have within 1%, 2%, 3%, 4%, 5%, 10%, 20%, 30%, 40%, 50%, 60%, 70%, 80%, 90%, 100% or greater esterase activity compared to the positive control cell.

See also, Bratosin D, Mitrofan L, Palii C, Estaquier J, Montreuil J. Novel fluorescence assay using calcein-AM for the determination of human erythrocyte viability and aging. Cytometry A. 2005 July; 66(1):78-84; and Jacob B C, Favre M, Bensa J C. Membrane cell permeabilisation with saponin and multiparametric analysis by flow cytometry. Cytometry 1991; 12:550-558.

Example 67: Measuring Acetylcholinesterase Activity in Fusosomes

Acetylcholinesterase activity is measured using a kit (MAK119, SIGMA) that follows a procedure described previously (Ellman, et al., Biochem. Pharmacol. 7, 88, 1961) and following the manufacturer's recommendations.

Briefly, fusosomes are suspended in 1.25 mM acetylthiocholine in PBS, pH 8, mixed with 0.1 mM 5,5-dithio-bis(2-nitrobenzoic acid) in PBS, pH 7. The incubation is performed at room temperature but the fusosomes and the substrate solution are pre-warmed at 37° C. for 10 min before starting the optical density readings.

Changes in absorption are monitored at 450 nm for 10 min with a plate reader spectrophotometer (ELX808, BIO-TEK instruments, Winooski, VT, USA). Separately, a sample is used for determining the protein content of the fusosomes via bicinchoninic acid assay for normalization. Using this assay, the fusosomes are determined to have <100 AChE activity units/μg of protein.

In some embodiments, AChE activity units/μg of protein values will be less than 0.001, 0.01, 0.1, 1, 10, 100, or 1000.

Example 68: Measuring Metabolic Activity Level

This Example describes quantification of the measurement of citrate synthase activity in fusosomes.

Citrate synthase is an enzyme within the tricarboxylic acid (TCA) cycle that catalyzes the reaction between oxaloacetate (OAA) and acetyl-CoA to generate citrate. Upon hydrolysis of acetyl-CoA, there is a release of CoA with a thiol group (CoA-SH). The thiol group reacts with a chemical reagent, 5,5-Dithiobis-(2-nitrobenzoic acid) (DTNB), to form 5-thio-2-nitrobenzoic acid (TNB), which is a yellow product that can be measured spectrophotometrically at 412 nm (Green 2008). Commercially-available kits, such as the Abcam Human Citrate Synthase Activity Assay Kit (Product #ab119692) provide all the necessary reagents to perform this measurement.

The assay is performed as per the manufacturer's recommendations. Fusosome sample lysates are prepared by collecting the fusosomes as produced by any one of the methods described in previous Examples and solubilizing them in Extraction Buffer (Abcam) for 20 minutes on ice. Supernatants are collected after centrifugation and protein content is assessed by bicinchoninic acid assay (BCA, ThermoFisher Scientific) and the preparation remains on ice until the following quantification protocol is initiated.

Briefly, fusosome lysate samples are diluted in 1× Incubation buffer (Abcam) in the provided microplate wells, with one set of wells receiving only 1× Incubation buffer. The plate is sealed and incubated for 4 hours at room temperature with shaking at 300 rpm. The buffer is then aspirated from the wells and 1× Wash buffer is added. This washing step is repeated once more. Then, 1× Activity solution is added to each well, and the plate is analyzed on a microplate reader by measuring absorbance at 412 nm every 20 seconds for 30 minutes, with shaking between readings.

Background values (wells with only 1× Incubation buffer) are subtracted from all wells, and the citrate synthase activity is expressed as the change in absorbance per minute per μg of fusosome lysate sample loaded (ΔmOD@412 nm/min/m protein). Only the linear portion from 100-400 seconds of the kinetic measurement is used to calculate the activity.

In some embodiments, a fusosome preparation will have within 1%, 2%, 3%, 4%, 5%, 10%, 20%, 30%, 40%, 50%, 60%, 70%, 80%, 90%, 100% or greater synthase activity compared to the control cell.

See, for example, Green H J et al. Metabolic, enzymatic, and transporter response in human muscle during three consecutive days of exercise and recovery. Am J Physiol Regul Integr Comp Physiol 295: R1238-R1250, 2008.

Example 69: Measuring Respiration Levels

This Example describes quantification of the measurement of respiration level in fusosomes. Respiration level in cells can be a measure of oxygen consumption, which powers metabolism. Fusosome respiration is measured for oxygen consumption rates by a Seahorse extracellular flux analyzer (Agilent) (Zhang 2012).

Fusosomes as produced by any one of the methods described in previous Examples or cells are seeded in a 96-well Seahorse microplate (Agilent). The microplate is centrifuged briefly to pellet the fusosomes and cells at the bottom of the wells. Oxygen consumption assays are initiated by removing growth medium, replacing with a low-buffered DMEM minimal medium containing 25 mM glucose and 2 mM glutamine (Agilent) and incubating the microplate at 37° C. for 60 minutes to allow for temperature and pH equilibrium.

The microplate is then assayed in an extracellular flux analyzer (Agilent) that measures changes in extracellular oxygen and pH in the media immediately surrounding adherent fusosomes and cells. After obtaining steady state oxygen consumption (basal respiration rate) and extracellular acidification rates, oligomycin (504), which inhibits ATP synthase, and proton ionophore FCCP (carbonyl cyanide 4-(trifluoromethoxy) phenylhydrazone; 204), which uncouples mitochondria, are added to each well in the microplate to obtain values for maximal oxygen consumption rates.

Finally, 5 μM antimycin A (inhibitor of mitochondria complex III) is added to confirm that respiration changes are due mainly to mitochondrial respiration. The minimum rate of oxygen consumption after antimycin A addition is subtracted from all oxygen consumption measurements to remove the non-mitochondrial respiration component. Cell samples that do not appropriately respond to oligomycin (at least a 25% decrease in oxygen consumption rate from basal) or FCCP (at least a 50% increase in oxygen consumption rate after oligomycin) are excluded from the analysis. Fusosomes respiration level is then measured as pmol O2/min/1e4 fusosomes.

This respiration level is then normalized to the respective cell respiration level. In some embodiments, fusosomes will have at least 1%, 2%, 3%, 4%, 5%, 10%, 20%, 30%, 40%, 50%, 60%, 70%, 80%, 90%, 100% or greater respiration level compared to the respective cell samples.

See, for example, Zhang J, Nuebel E, Wisidagama D R R, et al. Measuring energy metabolism in cultured cells, including human pluripotent stem cells and differentiated cells. Nature protocols. 2012; 7(6):10.1038/nprot.2012.048. doi: 10.1038/nprot.2012.048.

Example 70: Measuring Phosphatidylserine Levels of Fusosomes

This Example describes quantification of the level of annexin-V binding to the surface of fusosomes.

Dying cells can display phosphatidylserine on the cell surface which is a marker of apoptosis in the programmed cell death pathway. Annexin-V binds to phosphatidylserine, and thus, annexin-V binding is a proxy for viability in cells.

Fusosomes were produced as described herein. For detection of apoptosis signals, fusosomes or positive control cells were stained with 5% annexin V fluor 594 (A13203, Thermo Fisher, Waltham, MA). Each group (detailed in the table below) included an experimental arm that was treated with an apoptosis-inducer, menadione. Menadione was added at 100 μM menadione for 4 h. All samples were run on a flow cytometer (Thermo Fisher, Waltham, MA) and fluorescence intensity was measured with the YL1 laser at a wavelength of 561 nm and an emission filter of 585/16 nm. The presence of extracellular phophatidyl serine was quantified by comparing fluorescence intensity of annexin V in all groups.

The negative control unstained fusosomes were not positive for annexin V staining.

In some embodiments, fusosomes were capable of upregulating phosphatidylserine display on the cell surface in response to menadione, indicating that non-menadione stimulated fusosomes are not undergoing apoptosis. In some embodiments, positive control cells that were stimulated with menadione demonstrated higher-levels of annexin V staining than fusosomes not stimulated with menadione.

TABLE 22

Annexin V staining parameter

| Experimental Arm | Mean Fluorescence Intensity of Annexin V Signal (and standard deviation) |
|---|---|
| Unstained Fusosomes (negative control) | 941 (937) |
| Stained Fusosomes | 11257 (15826) |
| Stained Fusosomes + Menadione | 18733 (17146) |
| Stained Macrophages + Menadione (positive control) | 14301 (18142) |

Example 71: Measuring Juxtacrine-Signaling Levels

This Example describes quantification of juxtacrine-signaling in fusosomes.

Cells can form cell-contact dependent signaling via juxtacrine signaling. In some embodiments, presence of juxtacrine signaling in fusosomes will demonstrate that fusosomes can stimulate, repress, and generally communicate with cells in their immediate vicinity.

Fusosomes produced by any one of the methods described in previous Examples from mammalian bone marrow stromal cells (BMSCs) having partial or complete nuclear inactivation trigger IL-6 secretion via juxtacrine signaling in macrophages. Primary macrophages and BMSCs are co-cultured. Bone marrow-derived macrophages are seeded first into 6-well plates, and incubated for 24 h, then primary mouse BMSC-derived fusosomes or BMSC cells (positive control parental cells) are placed on the macrophages in a DMEM medium with 10% FBS. The supernatant is collected at different time points (2, 4, 6, 24 hours) and analyzed for IL-6 secretion by ELISA assay. (Chang J. et al., 2015).

In some embodiments, a level of juxtacrine signaling induced by BMSC fusosomes is measured by an increase in macrophage-secreted IL-6 levels in the media. In some embodiments, a level of juxtacrine signaling will be at least 1%, 2%, 3%, 4%, 5%, 10%, 20%, 30%, 40%, 50%, 60%, 70%, 80%, 90%, 100% or greater than the levels induced by the positive control bone marrow stromal cells (BMSCs).

Example 72: Measuring Paracrine-Signaling Levels

This Example describes quantification of paracrine signaling in fusosomes.

Cells can communicate with other cells in the local microenvironment via paracrine signaling. In some embodiments, fusosomes will be capable of paracrine signaling, e.g., to communicate with cells in their local environment. In some n embodiments, ability of fusosomes to trigger $Ca^{2+}$ signaling in endothelial cells via paracrine-derived secretion with the following protocol will measure $Ca^{2+}$ signaling via the calcium indicator, fluo-4 AM.

To prepare the experimental plate, murine pulmonary microvascular endothelial cells (MPMVECs) are plated on a 0.2% gelatin coated 25 mm glass bottom confocal dish (80% confluence). MPMVECs are incubated at room temperature for 30 min in ECM containing 2% BSA and 0.003% pluronic acid with 5 μM fluo-4 AM (Invitrogen) final concentration to allow loading of fluo-4 AM. After loading, MPMVECs are washed with experimental imaging solution (ECM containing 0.25% BSA) containing sulfinpyrazone to minimize dye loss. After loading fluo-4,500 μl of pre-warmed experimental imaging solution is added to the plate, and the plate is imaged by a Zeiss confocal imaging system.

In a separate tube, freshly isolated murine macrophages are either treated with 1 μg/mL LPS in culture media (DMEM+10% FBS) or not treated with LPS (negative control). After stimulation, fusosomes are generated from macrophages by any one of the methods described in previous Examples.

Fusosomes or parental macrophages (positive control) are then labeled with cell tracker red, CMTPX (Invitrogen), in ECM containing 2% BSA and 0.003% pluronic acid. Fusosomes and macrophages are then washed and resuspended in experimental imaging solution. Labeled fusosomes and macrophages are added onto the fluo-4 AM loaded MPMVECs in the confocal plate.

Green and red fluorescence signal is recorded every 3 s for 10-20 min using Zeiss confocal imaging system with argon ion laser source with excitation at 488 and 561 nm for fluo-4 AM and cell tracker red fluorescence respectively. Fluo-4 fluorescence intensity changes are analyzed using imaging software (Mallilankaraman, K. et al., *J Vis Exp.* (58): 3511, 2011). The level of Fluo-4 intensity measured in negative control fusosome and cell groups is subtracted from LPS-stimulated fusosome and cell groups.

In some embodiments, fusosomes, e.g., activated fusosomes, will induce an increase in Fluo-4 fluorescence intensity that is at least 1%, 2%, 3%, 4%, 5%, 10%, 20%, 30%, 40%, 50%, 60%, 70%, 80%, 90%, 100% or greater than the positive control cell groups.

Example 73: Measuring Ability to Polymerize Actin for Mobility

This Example describes quantification of cytoskeletal components, such as actin, in fusosomes. In some embodiments, fusosomes comprise cytoskeletal components such as actin, and are capable of actin polymerization.

Cells use actin, which is a cytoskeletal component, for motility and other cytoplasmic processes. The cytoskeleton is essential to creating motility driven forces and coordinating the process of movement C2C12 cells were enucleated as described herein. Fusosomes obtained from the 12.5% and 15% Ficoll layers were pooled and labeled 'Light', while fusosomes from the 16-17% layers were pooled and labeled 'Medium'. Fusosomes or cells (parental C2C12 cells, positive control) were resuspended in DMEM+Glutamax+10% Fetal Bovine Serum (FBS), plated in 24-well ultra-low attachment plates (#3473, Corning Inc, Corning, NY) and incubated at 37° C.+5% CO2. Samples were taken periodically (5.25 hr, 8.75 hr, 26.5 hr) and stained with 165 μM rhodamine phalloidin (negative control was not stained) and measured on a flow cytometer (#A24858, Thermo Fisher, Waltham, MA) with a FC laser YL1 (561 nm with 585/16 filter) to measure F-actin cytoskeleton content. The fluorescence intensity of rhodamine phalloidin in fusosomes was measured along with unstained fusosomes and stained parental C2C12 cells.

Figure 4:
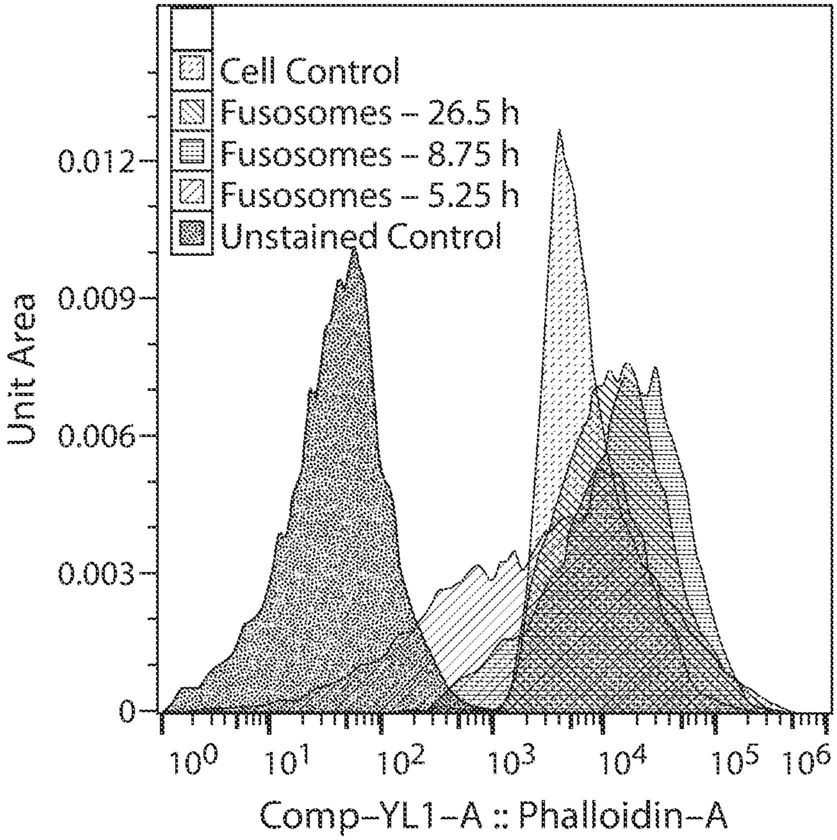
FIG. 4 quantifies staining of fusosomes with a dye for F-actin.

Fusosome fluorescence intensity was greater (FIG. 4) than the negative control at all timepoints, and fusosomes were capable of polymerizing actin at a similar rate to the parental C2C12 cells.

Additional cytoskeletal components, such as those listed in the table below, are measured via a commercially available ELISA systems (Cell Signaling Technology and MyBioSource), according to manufacturer's instructions.

TABLE 23

Cytoskeletal components

| Cytoskeletal protein measured | Commercial Kit Type | Kit ID |
|---|---|---|
| Actin | Path Scan Total B-Actin Sandwich ELISA Kit | Cell Signaling, 7880 |
| Arp2/3 | Human Actin Related protein 2/3 complex subunit(APRC2) ELISA KIT | MyBioSource, MBS7224740 |
| Formin | Formin Binding Protein 1 (FNBP1), ELISA Kit | MyBioSource, MBS9308864 |
| Coronin | Human Coronin 1A ELISA Kit | MyBioSource, MBS073640 |
| Dystrophin | Human dystrophin ELISA Kit | MyBioSource MBS722223 |
| Keratin | Human Keratin 5 ELISA Kit | MyBioSource, MBS081200 |
| Myosin | Human Myosin IG (MYO1G) ELISA Kit | MyBioSource, MBS9312965 |
| Tubulin | Human Tubulin Beta 3 ELISA Kit | MyBioSource, MBS097321 |

Then 100 μL of appropriately-diluted lysate is added to the appropriate well from the microwell strips. The microwells are sealed with tape and incubated for 2 hrs at 37° C. After incubation, the sealing tape is removed and the contents are discarded. Each microwell is washed four times with 200 μL of 1× Wash Buffer. After each individual wash, plates are struck onto an absorbent cloth so that the residual wash solution is removed from each well. However, wells are not completely dry at any time during the experiment.

Next, 100 μL of the reconstituted Detection Antibody (green) is added each individual well, except for negative control wells. Then wells are sealed and incubated for 1 hour at 37° C. The washing procedure is repeated after incubation is complete. 100 μL of reconstituted HRP-Linked secondary antibody (red) is added to each of the wells. The wells are sealed with tape and incubated for 30 minutes at 37° C. The sealing tape is then removed and the washing procedure is repeated. 100 μL of TMB Substrate is then added to each well. The wells are sealed with tape, then incubated for 10 minutes at 37° C. Once this final incubation is complete, 100 μL of STOP solution is added to each of the wells and the plate is shaken gently for several seconds.

Spectrophotometric analysis of the assay is conducted within 30 minutes of adding the STOP solution. The underside of the wells is wiped with lint-free tissue and then absorbance is read at 450 nm. In some embodiments, fusosome samples that have been stained with the detection antibody will absorb more light at 450 nm that negative control fusosome samples, and absorb less light than cell samples that have been stained with the detection antibody.

Example 74: Measuring Average Membrane Potential

This Example describes quantification of the mitochondrial membrane potential of fusosomes. In some embodiments, fusosomes comprising a mitochondrial membrane will maintain mitochondrial membrane potential.

Mitochondrial metabolic activity can be measured by mitochondrial membrane potential. The membrane potential of the fusosome preparation is quantified using a commercially available dye, TMRE, for assessing mitochondrial membrane potential (TMRE: tetramethyl rhodamine, ethyl ester, perchlorate, Abcam, Cat #T669).

Fusosomes are generated by any one of the methods described in previous Examples. Fusosomes or parental cells are diluted in growth medium (phenol-red free DMEM with 10% fetal bovine serum) in 6 aliquots (untreated and FCCP-treated triplicates). One aliquot of the samples is incubated with FCCP, an uncoupler that eliminates mitochondrial membrane potential and prevents TMRE staining. For FCCP-treated samples, 2 μM FCCP is added to the samples and incubated for 5 minutes prior to analysis. Fusosomes and parental cells are then stained with 30 nM TMRE. For each sample, an unstained (no TMRE) sample is also prepared in parallel. Samples are incubated at 37° C. for 30 minutes. The samples are then analyzed on a flow cytometer with 488 nm argon laser, and excitation and emission is collected at 530+/−30 nm.

Membrane potential values (in millivolts, mV) are calculated based on the intensity of TMRE. All events are captured in the forward and side scatter channels (alternatively, a gate can be applied to exclude small debris). The fluorescence intensity (FI) value for both the untreated and FCCP-treated samples are normalized by subtracting the geometric mean of the fluorescence intensity of the unstained sample from the geometric mean of the untreated and FCCP-treated sample. The membrane potential state for each preparation is calculated using the normalized fluorescent intensity values with a modified Nernst equation (see below) that can be used to determine mitochondrial membrane potential of the fusosomes or cells based on TMRE fluorescence (as TMRE accumulates in mitochondria in a Nernstian fashion).

Fusosome or cell membrane potential is calculated with the following formula: (mV)=−61.5*log(FIuntreated-normalized/FIFCCP-treated-normalized). In some embodiments, using this assay or an equivalent on fusosome preparations from C2C12 mouse myoblast cells, the membrane potential state of the fusosome preparation will be within about 1%, 2%, 3%, 4%, 5%, 10%, 20%, 30%, 40%, 50%, 60%, 70%, 80%, 90%, 100% or greater than the parental cells. In some embodiments, the range of membrane potential is about −20 to ~150 mV.

Example 75: Measuring Persistence Half-Life in a Subject

This Example describes the measurement of fusosome half-life.

Fusosomes are derived from cells that express *Gaussia*-luciferase produced by any one of the methods described in previous Examples, and pure, 1:2, 1:5, and 1:10 dilutions in buffered solution are made. A buffered solution lacking fusosomes is used as a negative control.

Each dose is administered to three eight week old male C57BL/6J mice (Jackson Laboratories) intravenously. Blood is collected from the retro-orbital vein at 1, 2, 3, 4, 5, 6, 12, 24, 48, and 72 hours after intravenous administration of the fusosomes. The animals are sacrificed at the end of the experiment by CO2 inhalation.

Blood is centrifuged for 20 min at room temperature. The serum samples are immediately frozen at −80° C. until bioanalysis. Then, each blood sample is used to carry out a *Gaussia*-luciferase activity assay after mixing the samples with *Gaussia*-luciferase substrate (Nanolight, Pinetop, AZ). Briefly, colenterazine, a luciferin or light-emitting molecule, is mixed with flash assay buffer and the mixture is pipetted into wells containing blood samples in a 96 well plate. Negative control wells that lack blood contain assay buffer to determine background *Gaussia* luciferase signal.

In addition, a standard curve of positive-control purified *Gaussia* luciferase (Athena Enzyme Systems, catalog #0308) is prepared in order to convert the luminescence signal to molecules of *Gaussia* luciferase secretion per hour. The plate is assayed for luminescence, using 500 msec integration. Background *Gaussia* luciferase signal is subtracted from all samples and then a linear best-fit curve is calculated for the *Gaussia* luciferase standard curve. If sample readings do not fit within the standard curve, they are diluted appropriately and re-assayed. The luciferase signal from samples taken at 1, 2, 3, 4, 5, 6, 12, 24, 48, and 72 hours is interpolated to the standard curve. The elimination rate constant $k_e$ ($h^{-1}$) is calculated using the following equation of a one-compartment model: $C(t)=C_0\times e^{-kext}$, in which C(t) (ng/mL) is the concentration of fusosomes at time t(h) and $C_0$ the concentration of fusosomes at time=0 (ng/mL). The elimination half-life $t_{1/2,e}$ (h) is calculated as $\ln(2)/k_e$.

In some embodiments, fusosomes will have a half-life of at least 1%, 2%, 3%, 4%, 5%, 10%, 20%, 30%, 40%, 50%, 60%, 70%, 80%, 90%, 100% or greater than the negative control cells.

Example 76: Measuring Retention of Fusosomes in Circulation

This example describes quantification of fusosome delivery into the circulation and retention at organs. In some embodiments, fusosomes are delivered into the circulation, and are not captured and retained in organ sites.

In some embodiments, fusosomes delivered into the peripheral circulation evade capture and retention by the reticulo-endothelial system (RES) in order to reach target sites with high efficiency. The RES comprises a system of cells, primarily macrophages, which reside in solid organs such as the spleen, lymph nodes and the liver. These cells are usually tasked with the removal of “old” cells, such as red blood cells.

Fusosomes are derived from cells expressing CRE recombinase (agent), or cells not expressing CRE (negative control). These fusosomes are prepared for in vivo injection as in Example 62.

The recipient mice harbor a loxp-luciferase genomic DNA locus that is modified by CRE protein made from mRNA delivered by the fusosomes to unblock the expression of luciferase (JAX #005125). Luciferase can be detected by bioluminescent imaging in a living animal. The positive control for this example are offspring of recipient mice mated to a mouse strain that expresses the same protein exclusively in macrophage and monocyte cells from its own genome (Cx3cr1-CRE JAX #025524). Offspring from this mating harbor one of each allele (loxp-luciferase, Cx3cr1-CRE).

Fusosomes are injected into the peripheral circulation via tail vein injection (IV, Example #48) into mice that harbor a genetic locus that when acted on by the CRE protein results in the expression of luciferase. The non-specific capture mechanism of the RES is phagocytic in nature releasing a proportion of the CRE protein from the fusosome into the macrophage resulting in genomic recombination. IVIS measurements (as described in Example 62) identify where non-fusogen controls accumulate and fuse. Accumulation in the spleen, lymph nodes and liver will be indicative of non-specific RES-mediated capture of the fusosome. IVIS is carried out at 24, 48 and 96 hours post-fusosome injection.

Mice are euthanized and spleen, liver and major lymphatic chain in the gut are harvested.

Genomic DNA is isolated from these organs and subjected to quantitative polymerase chain reaction against the recombined genomic DNA remnant. An alternative genomic locus (not targeted by CRE) is also quantified to provide a measure of the number of cells in the sample.

In embodiments, low bioluminescent signals will be observed for both the agent and negative control throughout the animal and specifically at the liver and splenic sites. In embodiments, the positive control will show increased signal in the liver (over negative control and agent) and high signals in the spleen and a distribution consistent with lymph nodes.

In some embodiments, genomic PCR quantification of these tissues will indicate a high proportion of the recombination signals over the alternative locus in the positive control in all tissues examined, while for or agent and negative controls, the level of recombination will be negligible in all tissues.

In some embodiments, the result of this Example will indicate that the non-fusogen controls are not retained by the RES and will be able to achieve broad distribution and exhibit high bioavailability.

Example 77: Fusosome Longevity with Immunosuppression

This Example describes quantification of the immunogenicity of a fusosome composition when it is co-administered with an immunosuppressive drug.

Therapies that stimulate an immune response can sometimes reduce the therapeutic efficacy or cause toxicity to the recipient. In some embodiments, fusosomes will be substantially non-immunogenic.

A purified composition of fusosomes as produced by any one of the methods described in previous Examples is co-administered with an immunosuppressive drug, and immunogenic properties are assayed by the longevity of the fusosome in vivo. A sufficient number of fusosomes, labeled with luciferase, are injected locally into the gastrocnemius muscle of a normal mouse with tacrolimus (TAC, 4 mg/kg/day; Sigma Aldrich), or vehicle (negative control), or without any additional agent (positive control). The mice are then subjected to in vivo imaging at 1, 2, 3, 4, 5, 6, 12, 24, 48, and 72 hours post injection.

Briefly, mice are anesthetized with isoflurane and D-luciferin is administered intraperitoneally at a dose of 375 mg per kilogram of body weight. At the time of imaging, animals are placed in a light-tight chamber, and photons emitted from luciferase expressing fusosomes transplanted into the animals are collected with integration times of 5 sec to 5 min, depending on the intensity of the bioluminescence emission. The same mouse is scanned repetitively at the various timepoints set forth above. BLI signal is quantified in units of photons per second (total flux) and presented as log [photons per second]. The data is analyzed by comparing the intensity and fusosome injection with and without TAC.

In embodiments, the assay will show an increase in fusosome longevity in the TAC co-administered group relative to the fusosome alone and vehicle groups at the final timepoint. In addition to the increase in fusosome longevity, in some embodiments, an increase in BLI signal from the fusosome plus TAC arm versus the fusosome plus vehicle or fusosomes alone at each of the time points will be observed.

Example 78: Measuring Pre-Existing IgG and IgM Antibodies Reactive Against Fusosomes This Example describes quantification of pre-existing anti-fusosome antibody titers measured using flow cytometry.

A measure of immunogenicity for fusosomes is antibody responses. Antibodies that recognize fusosomes can bind in manner that can limit fusosome activity or longevity. In some embodiments, some recipients of a fusosome described herein will have pre-existing antibodies which bind to and recognize fusosomes.

In this Example, anti-fusosome antibody titers are tested using fusosomes produced using a xenogeneic source cell by any one of the methods described in a previous Example. In this Example, a fusosome naïve mouse is assessed for the presence of anti-fusosome antibodies. Notably, the methods described herein may be equally applicable to humans, rats, monkeys with optimization to the protocol.

The negative control is mouse serum which has been depleted of IgM and IgG, and the positive control is serum derived from a mouse that has received multiple injections of fusosomes generated from a xenogeneic source cell.

To assess the presence of pre-existing antibodies which bind to fusosomes, sera from fusosome-naïve mice is first decomplemented by heating to 56° C. for 30 min and subsequently diluted by 33% in PBS containing 3% FCS and 0.1% NaN3. Equal amounts of sera and fusosomes ($1\times10^2$-$1\times10^8$ fusosomes per mL) suspensions are incubated for 30 min at 4° C. and washed with PBS through a calf-serum cushion.

IgM xenoreactive antibodies are stained by incubation of the cells with PE-conjugated goat antibodies specific for the Fc portion of mouse IgM (BD Bioscience) at 4° C. for 45 min. Notably, anti-mouse IgG1 or IgG2 secondary antibodies may also be used. Cells from all groups are washed twice with PBS containing 2% FCS and then analyzed on a FACS system (BD Biosciences). Fluorescence data are collected by use of logarithmic amplification and expressed as mean fluorescent intensity. In some embodiments, the negative control serum will show negligible fluorescence comparable to the no serum or secondary alone controls. In an embodiment, the positive control will show more fluorescence than the negative control, and more than the no serum or secondary alone controls. In an embodiment, in cases where immunogenicity occurs, serum from fusosome-naïve mice will show more fluorescence than the negative control. In an embodiment, in cases where immunogenicity does not occur, serum from fusosome-naïve mice will show similar fluorescence compared to the negative control.

Example 79: Measuring IgG and IgM Antibody Responses after Multiple Administrations of Fusosomes This Example describes quantification of the humoral response of a modified fusosome following multiple administrations of the modified fusosome. In some embodiments, a modified fusosome, e.g., modified by a method described herein, will have a reduced (e.g., reduced compared to administration of an unmodified fusosome) humoral response following multiple (e.g., more than one, e.g., 2 or more), administrations of the modified fusosome.

A measure of immunogenicity for fusosomes is the antibody responses. In some embodiments, repeated injections of a fusosome can lead to the development of anti-fusosome antibodies, e.g., antibodies that recognize fusosomes. In some embodiments, antibodies that recognize fusosomes can bind in a manner that can limit fusosome activity or longevity.

In this Example, anti-fusosome antibody titers are examined after one or more administrations of fusosomes. Fusosomes are produced by any one of the previous Examples. Fusosomes are generated from: unmodified mesenchymal stem cells (hereafter MSCs), mesenchymal stem cells modified with a lentiviral-mediated expression of HLA-G (hereafter MSC-HLA-G), and mesenchymal stem cells modified with a lentiviral-mediated expression of an empty vector (hereafter MSC-empty vector). Serum is drawn from the different cohorts: mice injected systemically and/or locally with 1, 2, 3, 5, 10 injections of vehicle (Fusosome naïve group), MSC fusosomes, MSC-HLA-G fusosomes, or MSC-empty vectors fusosomes.

To assess the presence and abundance of anti-fusosomes antibodies, sera from the mice is first decomplemented by heating to 56° C. for 30 min and subsequently diluted by 33% in PBS with 3% FCS and 0.1% NaN3. Equal amounts of sera and fusosomes ($1\times10^2$-$1\times10^8$ fusosomes per mL) are incubated for 30 min at 4° C. and washed with PBS through a calf-serum cushion.

Fusosome reactive IgM antibodies are stained by incubation of the cells with PE-conjugated goat antibodies specific for the Fc portion of mouse IgM (BD Bioscience) at 4° C.

for 45 min. Notably, anti-mouse IgG1 or IgG2 secondary antibodies may also be used. Cells from all groups are washed twice with PBS containing 2% FCS and then analyzed on a FACS system (BD Biosciences). Fluorescence data are collected by use of logarithmic amplification and expressed as mean fluorescent intensity.

In some embodiments, MSC-HLA-G fusosomes will have decreased anti-fusosome IgM (or IgG1/2) antibody titers (as measured by fluorescence intensity on FACS) after injections, as compared to MSC fusosomes or MSC-empty vector fusosomes.

Example 80: Modification of Fusosome Source Cells to Express Tolerogenic Protein to Reduce Immunogenicity This Example describes quantification of immunogenicity in fusosomes derived from a modified cell source. In some embodiments, fusosomes derived from a modified cell source have reduced immunogenicity in comparison to the fusosomes derived from an unmodified cell source.

Therapies that stimulate an immune response can sometimes reduce the therapeutic efficacy or cause toxicity to the recipient. In some embodiments, substantially non-immunogenic fusosomes are administered to a subject. In some embodiments, immunogenicity of the cell source can be assayed as a proxy for fusosome immunogenicity.

iPS cells modified using lentiviral mediated expression of HLA-G or expressing an empty vector (Negative control) are assayed for immunogenic properties as follows. A sufficient number of iPS cells, as a potential fusosome cell source, are injected into C57/B6 mice, subcutaneously in the hind flank and are given an appropriate amount of time to allow for teratomas to form.

Once teratomas are formed, tissues are harvested. Tissues prepared for fluorescent staining are frozen in OCT, and those prepared for immunohistochemistry and H&E staining are fixed in 10% buffered formalin and embedded in paraffin. The tissue sections are stained with antibodies, polyclonal rabbit anti-human CD3 anti-body (DAKO), mouse anti-human CD4 mAb (RPA-T4, BD PharMingen), mouse anti-human CD8 mAb (RPA-T8, BD PharMingen), in accordance with general immunohistochemistry protocols. These are detected by using an appropriate detection reagent, namely an anti-mouse secondary HRP (Thermofisher), or anti-rabbit secondary HRP (Thermofisher).

Detection is achieved using peroxidase-based visualization systems (Agilent). The data is analyzed by taking the average number of infiltrating CD4+ T-cells, CD8+ T-cells, CD3+ NK-cells present in 25, 50 or 100 tissue sections examined in a 20× field using a light microscope. In embodiments, iPSCs which are not modified or iPSCs expressing an empty vector will have a higher number of infiltrating CD4+ T-cells, CD8+ T-cells, CD3+ NK-cells present in the fields examined as compared to iPSCs that express HLA-G.

In some embodiments, a fusosome's immunogenic properties will be substantially equivalent to that of the source cell. In some embodiments, fusosomes derived from iPS cells modified with HLA-G will have reduced immune cell infiltration versus their unmodified counterparts.

Example 81: Modification of Fusosome Source Cells to Knockdown Immunogenic Protein to Reduce Immunogenicity This Example describes quantification of the generation of a fusosome composition derived from a cell source, which has been modified to reduce expression of a molecule which is immunogenic. In some embodiments, a fusosome can be derived from a cell source, which has been modified to reduce expression of a molecule which is immunogenic.

Therapies that stimulate an immune response can reduce the therapeutic efficacy or cause toxicity to the recipient. Thus, immunogenicity is an important property for a safe and effective therapeutic fusosomes. Expression of certain immune activating agents can create an immune response. MHC class I represents one example of an immune activating agent.

In this Example, fusosomes are generated by any one of the methods described in previous Examples. Fusosomes are generated from: unmodified mesenchymal stem cells (hereafter MSCs, positive control), mesenchymal stem cells modified with a lentiviral-mediated expression of an shRNA targeting MHC class I (hereafter MSC-shMHC class I), and mesenchymal stem cells modified with a lentiviral-mediated expression of a non-targeted scrambled shRNA (hereafter MSC-scrambled, negative control).

Fusosomes are assayed for expression of MHC class I using flow cytometry. An appropriate number of fusosomes are washed and resuspended in PBS, held on ice for 30 minutes with 1:10-1:4000 dilution of fluorescently conjugated monoclonal antibodies against MHC class I (Harlan Sera-Lab, Belton, UK). Fusosomes are washed three times in PBS and resuspended in PBS. Nonspecific fluorescence is determined, using equal aliquots of fusosomes preparation incubated with and appropriate fluorescently conjugated isotype control antibody at equivalent dilutions. Fusosomes are assayed in a flow cytometer (FACSort, Becton-Dickinson) and the data is analyzed with flow analysis software (Becton-Dickinson).

The mean fluorescence data of the fusosomes derived from MSCs, MSCs-shMHC class I, MSC-scrambled, is compared. In some embodiments, fusosomes derived from MSCs-shMHC class I will have lower expression of MHC class I compared to MSCs and MSC-scrambled.

Example 82: Modification of Fusosome Source Cells to Evade Macrophage Phagocytosis This Example describes quantification of the evasion of phagocytosis by modified fusosomes. In some embodiments, modified fusosomes will evade phagocytosis by macrophages.

Cells engage in phagocytosis, engulfing particles, enabling the sequestration and destruction of foreign invaders, like bacteria or dead cells. In some embodiments, phagocytosis of fusosomes by macrophages would reduce their activity.

Fusosomes are generated by any one of the methods described in previous Examples. Fusosomes are created from: CSFE-labelled mammalian cells which lack CD47 (hereafter NMC, positive control), CSFE-labelled cells that are engineered to express CD47 using lentiviral mediated expression of a CD47 cDNA (hereafter NMC-CD47), and CSFE-labelled cells engineered using lentiviral mediated expression of an empty vector control (hereafter NMC-empty vector, negative control).

Reduction of macrophage mediate immune clearance is determined with a phagocytosis assay according to the following protocol. Macrophages are plated immediately after harvest in confocal glass bottom dishes. Macrophages are incubated in DMEM+10% FBS+1% P/S for 1 h to attach. An appropriate number of fusosomes derived from NMC, NMC-CD47, NMC-empty vector are added to the macrophages as indicated in the protocol, and are incubated for 2 h, tools.thermofisher.com/content/sfs/manuals/mp06694.pdf.

After 2 h, the dish is gently washed and intracellular fluorescence is examined. Intracellular fluorescence emitted by engulfed particles is imaged by confocal microscopy at 488 excitation. The number of phagocytotic positive macrophage is quantified using imaging software. The data is expressed as the phagocytic index=(total number of engulfed cells/total number of counted macrophages)×(number of macrophages containing engulfed cells/total number of counted macrophages)×100.

In some embodiments, a phagocytic index will be reduced when macrophages are incubated with fusosomes derived from NMC-CD47, versus those derived from NMC, or NMC-empty vector.

Example 83: Modification of Fusosome Source Cells for Decreased Cytotoxicity Mediated by PBMC Cell Lysis This Example described the generation of fusosomes derived from cells modified to have decreased cytotoxicity due to cell lysis by PBMCs.

In some embodiments, cytotoxicity mediated cell lysis of source cells or fusosomes by PBMCs is a measure of immunogenicity for fusosomes, as lysis will reduce, e.g., inhibit or stop, the activity of a fusosome.

In this Example, fusosomes are generated by any one of the methods described in a previous Example. Fusosomes are created from: unmodified mesenchymal stem cells (hereafter MSCs, positive control), mesenchymal stem cells modified with a lentiviral-mediated expression of HLA-G (hereafter MSC-HLA-G), and mesenchymal stem cells modified with a lentiviral-mediated expression of an empty vector (hereafter MSC-empty vector, negative control).

PMBC mediated lysis of a fusosome is determined by europium release assays as described in Bouma, et al. Hum. Immunol. 35(2):85-92; 1992 & van Besouw et al. Transplantation 70(1):136-143; 2000. PBMCs (hereafter effector cells) are isolated from an appropriate donor, and stimulated with allogeneic gamma irradiated PMBCs and 2001 U/mL IL-2 (proleukin, Chiron BV Amsterdam, The Netherlands) in a round bottom 96 well plate for 7 days at 37° C. The fusosomes are labeled with europium-diethylenetriamine-pentaacetate (DTPA) (sigma, St. Louis, MO, USA).

At day 7 cytotoxicity-mediated lysis assays is performed by incubating $^{63}$Eu-labelled fusosomes with effector cells in a 96-well plate for 1, 2, 3, 4, 5, 6, 8, 10, 15, 20, 24, 48 hours after plating at effector/target ratios ranging from 1000:1-1:1 and 1:1.25-1:1000. After incubation, the plates are centrifuged and a sample of the supernatant is transferred to 96-well plates with low background fluorescence (fluoroimmunoplates, Nunc, Roskilde, Denmark).

Subsequently, enhancement solution (PerkinElmer, Groningen, The Netherlands) is added to each well. The released europium is measured in a time-resolved fluorometer (Victor 1420 multilabel counter, LKB-Wallac, Finland). Fluorescence is expressed in counts per second (CPS). Maximum percent release of europium by a target fusosome is determined by incubating an appropriate number ($1\times10^2$-$1\times10^8$) of fusosomes with 1% triton (sigma-aldrich) for an appropriate amount of time. Spontaneous release of europium by target fusosomes is measured by incubation of labeled target fusosomes without effector cells. Percentage leakage is then calculated as: (spontaneous release/maximum release)×100%. Finally, the percentage of cytotoxicity mediated lysis is calculated as % lysis=[(measured lysis-spontaneous lysis-spontaneous release)/(maximum release-spontaneous release)]×100%. The data is analyzed by looking at the percentage of lysis as a function of different effector target ratios.

In some embodiments, fusosomes generated from MSC-HLA-G cells will have a decreased percentage of lysis by target cells, at specific timepoints as compared to MSCs or MSC-scrambled generated fusosomes.

Example 84: Modification of Fusosome Source Cells for Decreased NK Lysis Activity This Example describes the generation of a fusosome composition derived from a cell source, which has been modified to decrease cytotoxicity mediated cell lysis by NK cells. In some embodiments cytotoxicity mediated cell lysis of source cells or fusosomes by NK cells is a measure of immunogenicity for fusosomes.

In this Example, fusosomes are generated by any one of the methods described in a previous Example. Fusosomes are created from: unmodified mesenchymal stem cells (hereafter MSCs, positive control), mesenchymal stem cells modified with a lentiviral-mediated expression of HLA-G (hereafter MSC-HLA-G), and mesenchymal stem cells modified with a lentiviral-mediated expression of an empty vector (hereafter MSC-empty vector, negative control).

NK cell mediated lysis of a fusosome is determined by europium release assays as described in Bouma, et al. Hum. Immunol. 35(2):85-92; 1992 & van Besouw et al. Transplantation 70(1):136-143; 2000. NK cells (hereafter effector cells) are isolated from an appropriate donor according to the methods in Crop et al. Cell transplantation (20):1547-1559; 2011, and stimulated with allogeneic gamma irradiated PMBCs and 2001 U/mL IL-2 (proleukin, Chiron BV Amsterdam, The Netherlands) in a round bottom 96 well plate for 7 days at 37° C. The fusosomes are labeled with europium-diethylenetriaminepentaacetate (DTPA) (sigma, St. Louis, MO, USA).

At day 7 cytotoxicity-mediated lysis assays is performed by incubating $^{63}$Eu-labelled fusosomes with effector cells in a 96-well plate for 1, 2, 3, 4, 5, 6, 8, 10, 15, 20, 24, 48 hours after plating at effector/target ratios ranging from 1000:1-1:1 and 1:1.25-1:1000. After incubation, the plates are centrifuged and a sample of the supernatant is transferred to 96-well plates with low background fluorescence (fluoroimmunoplates, Nunc, Roskilde, Denmark).

Subsequently, enhancement solution (PerkinElmer, Groningen, The Netherlands) is added to each well. The released europium is measured in a time-resolved fluorometer (Victor 1420 multilabel counter, LKB-Wallac, Finland). Fluorescence is expressed in counts per second (CPS). Maximum percent release of europium by a target fusosome is determined by incubating an appropriate number ($1\times10^2$-$1\times10^8$) of fusosomes with 1% triton (Sigma-Aldrich) for an appropriate amount of time. Spontaneous release of europium by target fusosomes is measured by incubation of labeled target fusosomes without effector cells. Percentage leakage is then calculated as: (spontaneous release/maximum release)×100%. Finally, the percentage of cytotoxicity mediated lysis is calculated as % lysis=[(measured lysis-spontaneous lysis-spontaneous release)/(maximum release-spontaneous release)]×100%. The data is analyzed by looking at the percentage of lysis as a function of different effector target ratios.

In some embodiments, fusosomes generated from MSC-HLA-G cells will have a decreased percentage of lysis at appropriate timepoints as compared to MSCs or MSC-scrambled generated fusosomes.

Example 85: Modification of Fusosome Source Cells for Decreased CD8 Killer T Cell Lysis This Example describes the generation of a fusosome composition derived from a cell source, which has been modified to decrease cytotoxicity mediated cell lysis by CD8+ T-cells. In some embodiments, cytotoxicity mediated cell lysis of source cells or fusosomes by CD8+ T-cells is a measure of immunogenicity for fusosomes.

In this Example, fusosomes are generated by any one of the methods described in a previous Example. Fusosomes are created from: unmodified mesenchymal stem cells (hereafter MSCs, positive control), mesenchymal stem cells modified with a lentiviral-mediated expression of HLA-G (hereafter MSC-HLA-G), and mesenchymal stem cells modified with a lentiviral-mediated expression of an empty vector (hereafter MSC-empty vector, negative control).

CD8+ T cell mediated lysis of a fusosome is determined by europium release assays as described in Bouma, et al. Hum. Immunol. 35(2):85-92; 1992 & van Besouw et al. Transplantation 70(1):136-143; 2000. CD8+ T-cells (hereafter effector cells) are isolated from an appropriate donor according to the methods in Crop et al. Cell transplantation (20):1547-1559; 2011, and stimulated with allogeneic gamma irradiated PMBCs and 2001 U/mL IL-2 (proleukin, Chiron BV Amsterdam, The Netherlands) in a round bottom 96 well plate for 7 days at 37° C. The fusosomes are labeled with europium-diethylenetriaminepentaacetate (DTPA) (sigma, St. Louis, MO, USA).

At day 7 cytotoxicity-mediated lysis assays is performed by incubating $^{63}$Eu-labelled fusosomes with effector cells in a 96-well plate for 1, 2, 3, 4, 5, 6, 8, 10, 15, 20, 24, 48 hours after plating at effector/target ratios ranging from 1000:1-1:1 and 1:1.25-1:1000. After incubation, the plates are centrifuged and 20 μL of the supernatant is transferred to 96-well plates with low background fluorescence (fluoroimmunoplates, Nunc, Roskilde, Denmark).

Subsequently, enhancement solution (PerkinElmer, Groningen, The Netherlands) is added to each well. The released europium is measured in a time-resolved fluorometer (Victor 1420 multilabel counter, LKB-Wallac, Finland). Fluorescence is expressed in counts per second (CPS). Maximum percent release of europium by a target fusosome is determined by incubating an appropriate number ($1\times10^2$-$1\times10^8$) of fusosomes with 1% triton (sigma-aldrich) for an appropriate amount of time. Spontaneous release of europium by target fusosomes is measured by incubation of labeled target fusosomes without effector cells. Percentage leakage is then calculated as: (spontaneous release/maximum release)× 100%. Finally, the percentage of cytotoxicity mediated lysis is calculated as % lysis=[(measured lysis-spontaneous lysis-spontaneous release)/(maximum release-spontaneous release)]×100%. The data is analyzed by looking at the percentage of lysis as a function of different effector target ratios.

In some embodiments, fusosomes generated from MSC-HLA-G cells will have a decreased percentage of lysis at appropriate timepoints as compared to MSCs or MSC-scrambled generated fusosomes.

Example 86: Modification of Fusosome Source Cells for Decreased T-Cell Activation This Example describes the generation of modified fusosomes that will have reduced T cell activation and proliferation as assessed by a mixed lymphocyte reaction (MLR). T-cell proliferation and activation are measures of immunogenicity for fusosomes. Stimulation of T cell proliferation in an MLR reaction by a fusosome composition, could suggest a stimulation of T cell proliferation in vivo.

In some embodiments, fusosomes generated from modified source cells have reduced T cell activation and proliferation as assessed by a mixed lymphocyte reaction (MLR). In some embodiments, fusosomes generated from modified source cells do not generate an immune response in vivo, thus maintaining the efficacy of the fusosome composition.

In this Example, fusosomes are generated by any one of the methods described in a previous Example. Fusosomes are generated from: unmodified mesenchymal stem cells (hereafter MSCs, positive control), mesenchymal stem cells modified with a lentiviral-mediated expression of IL-10 (hereafter MSC-IL-10), and mesenchymal stem cells modified with a lentiviral-mediated expression of an empty vector (hereafter MSC-empty vector, negative control).

BALB/c and C57BL/6 splenocytes are used as either stimulator or responder cells. Notably, the source of these cells can be exchanged with commonly used human-derived stimulator/responder cells. Additionally, any mammalian purified allogeneic CD4+ T cell population, CD8+ T-cell population, or CD4−/CD8− may be used as responder population.

Mouse Splenocytes are isolated by mechanical dissociation using fully frosted slides followed by red blood cell lysis with lysing buffer (Sigma-Aldrich, St-Louis, MO). Prior to the experiment, stimulator cells are irradiated with 20 Gy of γray to prevent them from reacting against responder cells. A co-culture is then made by adding equal numbers of stimulator and responder cells (or alternative concentrations while maintaining a 1:1 ratio) to a round bottom 96-well plate in complete DMEM-10 media. An appropriate number of fusosomes (at several concentrations from a range of $1\times10^1$-$1\times10^8$) are added to the co-culture at different time intervals, t=0, 6, 12, 24, 36, 48 h.

Proliferation is assessed by adding 1 μCi of [$^3$H]-thymidine (Amersham, Buckinghamshire, UK) to allow for incorporation. [$^3$H]-thymidine is added to the MLR at t=2, 6, 12, 24, 36, 48, 72 h, and the cells are harvested onto glass fiber filters using a 96 well cell harvester (Inoteck, Bertold, Japan) after 2, 6, 12, 18, 24, 36 and 48 h of extended culture. All of the T-cell proliferation experiments are done in triplicate. [$^3$H]-thymidine incorporation is measured using a microbeta ILuminescence counter (Perkin Elmer, Wellesley, MA). The results can be represented as counts per minute (cpm).

In some embodiments, MSC-IL10 fusosomes will show a decrease in T-cell proliferation as compared to the MSC-Empty vector or the MSC unmodified fusosome controls.

Example 87: Measuring Targeting Potential in a Subject

This Example assesses the ability of a fusosome to target a specific body site. In some embodiments, a fusosome can target a specific body site. Targeting is a way to restrict activity of a therapeutic to one or more relevant therapeutic sites.

Eight week old C57BL/6J mice (Jackson Laboratories) are intravenously injected with fusosomes or cells that express firefly luciferase. Fusosomes are produced from cells that stably express firefly luciferase or cells that do not express luciferase (negative control) by any one of the methods described in previous Examples. Groups of mice are euthanized at one, two, three, four, five, six, eight, twelve, and twenty-four hours after fusosome or cell injection.

Five minutes before euthanization, mice receive an IP injection of bioluminescent substrate (Perkin Elmer) at a dose of 150 mg/kg in order to visualize luciferase. The bioluminescent imaging system is calibrated to compensate for all device settings. Mice are then euthanized and liver, lungs, heart, spleen, pancreas, GI, and kidney are collected. The imaging system (Perkin Elmer) is used to obtain images of bioluminescence of these ex vivo organs. The bioluminescent signal is measured using Radiance Photons, with Total Flux used as a measured value. The region of interest (ROI) is generated by surrounding the ex vivo organ in order to give a value in photons/second. The ratio of photons/second between target organs (e.g. liver) and non-target organs (e.g. the sum of photons/second from lungs, heart, spleen, pancreas, GI, and kidney) is calculated as a measure of targeting to the liver.

In some embodiments, in both fusosomes and cells, the ratio of photons/second between liver and the other organs will be greater than 1, which would indicate that fusosomes target the liver. In some embodiments, negative control animals will display much lower photons/second in all organs.

Example 88: Measuring Delivery of an Exogenous Agent in a Subject

This Example describes quantification of delivery of fusosomes comprising an exogenous agent in a subject. Fusosomes are prepared from cells expressing *Gaussia*-luciferase or from cells not expressing luciferase (negative control) by any one of the methods described in previous Examples.

Positive control cells or fusosomes are intravenously injected into mice. Fusosomes or cells are delivered within 5-8 seconds using a 26-gauge insulin syringe-needle. In vivo bioluminescent imaging is performed on mice 1, 2, or 3 days after injection using an in vivo imaging system (Xenogen Corporation, Alameda, CA).

Immediately before use, coelenterazine, a luciferin or light-emitting molecule, (5 mg/mL) is prepared in acidified methanol and injected immediately into the tail vein of the mice. Mice are under continuous anesthesia on a heated stage using the XGI-8 Gas Anesthesia System.

Bioluminescence imaging is obtained by acquiring photon counts over 5 min immediately after intravenous tail-vein injection of coelenterazine (4 μg/g body weight). Acquired data are analyzed using software (Xenogen) with the overlay on light-view image. Regions of interest (ROI) are created using an automatic signal intensity contour tool and normalized with background subtraction of the same animal. A sequential data acquisition using three filters at the wavelengths of 580, 600 and 620 nm with exposure time 3-10 min is conducted to localize bioluminescent light sources inside a mouse.

Furthermore, at each timepoint, urine samples are collected by abdominal palpation.

Blood samples (50 μL) are obtained from the tail vein of each mouse into heparinized or EDTA tubes. For plasma isolation, blood samples are centrifuged for 25 min at 1.3×g at 4° C.

Then, 5 μL of blood, plasma or urine sample are used to carry out a *Gaussia*-luciferase activity assay after mixing the samples with 50 μM *Gaussia*-luciferase substrate (Nanolight, Pinetop, AZ).

In some embodiments, a negative control sample will be negative for luciferase, and a positive control sample will be from animals administered cells. In some embodiments, samples from animals administered fusosomes expressing *Gaussia*-luciferase will be positive for luciferase in each sample.

See, for example, El-Amouri S S et al., *Molecular biotechnology* 53(1): 63-73, 2013.

Example 89: Active Transport Across a Lipid Bilayer of a Fusosome

This example describes quantification of the level of 2-NBDG (2-(N-(7-Nitrobenz-2-oxa-1,3-diazol-4-yl) Amino)-2-Deoxyglucose), a fluorescent glucose analog that can be used to monitor glucose uptake in live cells and thus active transport across the lipid bilayer. In some embodiments, this assay or an equivalent can be used to measure the level of glucose uptake and active transport across the lipid bilayer of the fusosome.

A fusosome composition as produced by any one of the methods described in previous Examples. A sufficient number of fusosomes are then incubated in DMEM containing no glucose, 20% Fetal Bovine Serum and 1× Penicillin/Streptomycin for 2 hr at 37° C. and 5% $CO_2$. After the 2 hr glucose starvation period, the medium is changed such that it includes DMEM with no glucose, 20% Fetal Bovine Serum, 1× Penicillin/Streptomycin, and 20 μM 2-NBDG (ThermoFisher) and incubated for 2 hr at 37° C. and 5% CO2. Negative control fusosomes are treated the same, except an equal amount of DMSO, the vehicle for 2-NBDG is added in place of 2-NBDG.

The fusosomes are then washed thrice with 1×PBS and re-suspended in an appropriate buffer, and transferred to a 96 well imaging plate. 2-NBDG fluorescence is then measured in a fluorimeter using a GFP light cube (469/35 excitation filter and a 525/39 emission filter) to quantify the amount of 2-NBDG that has transported across the fusosome membrane and accumulated in the fusosome in the 1 hr loading period.

In some embodiments, 2-NBDG fluorescence will be higher in the fusosomes with 2-NBDG treatment as compared to the negative (DMSO) control. Fluorescence measure with a 525/39 emission filter will be relatively to the number of 2-NBDG molecules present.

Example 90: Delivery of Fusosomes Via Non-Endocytic Pathway

This example describes quantification of fusosome delivery of Cre to a recipient cell via a non-endocytic pathway.

In some embodiments, fusosomes will deliver agents via a fusosome-mediated, non-endocytic pathway. Without wishing to be bound by theory, delivery of an agent, e.g., Cre, which is carried within the lumen of the fusosomes, directly to the cytosol of the recipient cells without any requirement for endocytosis-mediated uptake of the fusosomes, will occur through a fusosome-mediated, non-endocytic pathway delivery.

In this example, the fusosome comprises a HEK293T cell expressing the Sendai virus H and F protein on its plasma membrane (Tanaka et al., 2015, Gene Therapy, 22 (October 2014), 1-8. https://doi.org/10.1038/gt.2014.123). In addition, the fusosome expresses mTagBFP2 fluorescent protein and Cre recombinase. The target cell is a RPMI8226 cell which stably-expresses "LoxP-GFP-stop-LoxP-RFP" cassette under a CMV promoter, which upon recombination by Cre switches from GFP to RFP expression, indicating fusion and Cre, as a marker, delivery.

Fusosomes produced by the herein described methods are assayed for delivery of Cre via a non-endocytic pathway as follows. The recipient cells are plated into a black, clear-bottom 96-well plate. Next, 24 hours after plating the recipient cells, the fusosomes expressing Cre recombinase protein and possessing the particular fusogen protein are applied to the recipient cells in DMEM media. To determine the level of Cre delivery via a non-endocytic pathway, a parallel group of recipient cells receiving fusosomes is treated with an inhibitor of endosomal acidification, chloroquine (30 μg/mL). The dose of fusosomes is correlated to the number of recipient cells plated in the well. After applying the fusosomes, the cell plate is centrifuged at 400 g for 5 minutes to help initiate contact between the fusosomes and the recipient cells. The cells are then incubated for 16 hours and agent delivery, Cre, is assessed via imaging.

The cells are imaged to positively identify RFP-positive cells versus GFP-positive cells in the field or well. In this example cell plates are imaged using an automated fluorescence microscope. The total cell population in a given well is determined by first staining the cells with Hoechst 33342 in DMEM media for 10 minutes. Hoechst 33342 stains cell nuclei by intercalating into DNA and therefore is used to identify individual cells. After staining, the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of the different cell groups are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings.

Analysis of GFP and RFP-positive wells is performed with software provided with the fluorescence microscope or other software (Rasband, W. S., ImageJ, U. S. National Institutes of Health, Bethesda, Maryland, USA, 1997-2007). The images are pre-processed using a rolling ball background subtraction algorithm with a 60 μm width. The total cell mask is set on the Hoechst-positive cells. Cells with Hoechst intensity significantly above background intensities are used to set a threshold, and areas too small or large to be Hoechst-positive cells are excluded.

Within the total cell mask, GFP and RFP-positive cells are identified by again setting a threshold for cells significantly above background and extending the Hoechst (nuclei) masks for the entire cell area to include the entire GFP and RFP cellular fluorescence.

The number of RFP-positive cells identified in control wells containing recipient cells is used to subtract from the number of RFP-positive cells in the wells containing fusosomes (to subtract for non-specific Loxp recombination). The number of RFP-positive cells (recipient cells that received Cre) is then divided by the sum of GFP-positive cells (recipient cells that have not received Cre) and RFP-positive cells to quantify the fraction of fusosome Cre delivered to the recipient cell population. The level is normalized to the given dose of fusosomes applied to the recipient cells. To calculate the value of fusosome Cre delivered via a non-endocytic pathway, the level of fusosome Cre delivery in the presence of chloroquine (FusL+CQ) is determined as well as the level of fusosome Cre delivery in the absence of chloroquine (FusL−CQ). To determine the normalized value of fusosome Cre delivered via a non-endocytic pathway, the following equation is used: [(FusL−CQ)−(FusL+CQ)]/(FusL−CQ).

In some embodiments, an average level of fusosome Cre delivered via a non-endocytic pathway for a given fusosome will be in the range of 0.1-0.95, or at least 1%, 2%, 3%, 4%, 5%, 10%, 20%, 30%, 40%, 50%, 60%, 70%, 80%, 90% or greater than chloroquine treated recipient cells.

Example 91: Delivery of Fusosomes Via Endocytic Pathway

This example describes fusosome delivery of Cre to a recipient cell via an endocytic pathway.

In some embodiments, fusosomes will deliver agents via a fusosome-mediated, endocytic pathway. Without wishing to be bound by theory, delivery of an agent, e.g., a cargo, carried in the lumen of the fusosomes, to the recipient cells with the route of uptake being endocytosis-dependent will occur through a fusosome-mediated, endocytic pathway delivery.

In this example the fusosome comprises microvesicles that were produced by extruding a HEK293T cell expressing a fusogen protein on its plasma membrane through a 2 μm filter (Lin et al., 2016, Biomedical Microdevices, 18(3). doi.org/10.1007/s10544-016-0066-y)(Riedel, Kondor-Koch, & Garoff, 1984, The EMBO Journal, 3(7), 1477-83. Retrieved from www.ncbi.nlm.nih.gov/pubmed/6086326). In addition, the fusosome expresses mTagBFP2 fluorescent protein and Cre recombinase. The target cell is a PC3 cell which stably-expresses "LoxP-GFP-stop-LoxP-RFP" cassette under a CMV promoter, which upon recombination by Cre switches from GFP to RFP expression, indicating fusion and Cre, as a marker, delivery.

Fusosomes produced by the herein described methods are assayed for delivery of Cre via an endocytic pathway as follows. The recipient cells are plated into a cell culture multi-well plate compatible with the imaging system to be used (in this example cells are plated in a black, clear-bottom 96-well plate). Next, 24 hours after plating the recipient cells, the fusosomes expressing Cre recombinase protein and possessing the particular fusogen protein are applied to the recipient cells in DMEM media. To determine the level of Cre delivery via an endocytic pathway, a parallel group of recipient cells receiving fusosomes is treated with an inhibitor of endosomal acidification, chloroquine (30 μg/mL). The dose of fusosomes is correlated to the number of recipient cells plated in the well. After applying the fusosomes, the cell plate is centrifuged at 400 g for 5 minutes to help initiate contact between the fusosomes and the recipient cells. The cells are then incubated for 16 hours and agent delivery, Cre, is assessed via imaging.

The cells are imaged to positively identify RFP-positive cells versus GFP-positive cells in the field or well. In this example cell plates are imaged using an automated fluorescent microscope. The total cell population in a given well is determined by first staining the cells with Hoechst 33342 in DMEM media for 10 minutes. Hoechst 33342 stains cell nuclei by intercalating into DNA and therefore is used to identify individual cells. After staining the Hoechst media is replaced with regular DMEM media.

The Hoechst is imaged using the 405 nm LED and DAPI filter cube. GFP is imaged using the 465 nm LED and GFP filter cube, while RFP is imaged using 523 nm LED and RFP filter cube. Images of the different cell groups are acquired by first establishing the LED intensity and integration times on a positive-control well; i.e., recipient cells treated with adenovirus coding for Cre recombinase instead of fusosomes.

Acquisition settings are set so that RFP and GFP intensities are at the maximum pixel intensity values but not saturated. The wells of interest are then imaged using the established settings.

Analysis of GFP and RFP-positive wells is performed with software provided with the fluorescent microscope or other software (Rasband, W. S., ImageJ, U. S. National Institutes of Health, Bethesda, Maryland, USA, 1997-2007). The images are pre-processed using a rolling ball background subtraction algorithm with a 60 μm width. The total cell mask is set on the Hoechst-positive cells. Cells with Hoechst intensity significantly above background intensities are thresholded and areas too small or large to be Hoechst-positive cells are excluded.

Within the total cell mask, GFP and RFP-positive cells are identified by again thresholding for cells significantly above background and extending the Hoechst (nuclei) masks for the entire cell area to include the entire GFP and RFP cellular fluorescence.

The number of RFP-positive cells identified in control wells containing recipient cells is used to subtract from the number of RFP-positive cells in the wells containing fusosomes (to subtract for non-specific Loxp recombination). The number of RFP-positive cells (recipient cells that received Cre) is then divided by the sum of the GFP-positive cells (recipient cells that have not received Cre) and RFP-positive cells to quantify the fraction of fusosome Cre delivered to the recipient cell population. The level is normalized to the given dose of fusosomes applied to the recipient cells. To calculate the value of fusosome Cre delivered via an endocytic pathway, the level of fusosome Cre delivery in the presence of chloroquine (FusL+CQ) is determined as well as the level of fusosome Cre delivery in the absence of chloroquine (FusL−CQ). To determine the normalized value of fusosome Cre delivered via an endocytic pathway, the following equation is used: (FusL+CQ)/(FusL−CQ).

In some embodiments, an average level of fusosome Cre delivered via an endocytic pathway for a given fusosome will be in the range of 0.01-0.6, or at least 1%, 2%, 3%, 4%, 5%, 10%, 20%, 30%, 40%, 50%, 60%, 70%, 80%, 90% or greater than chloroquine treated recipient cells.

Example 92: Delivery of Fusosomes Via a Dynamin Mediated Pathway, a Macropinocytosis Pathway, or an Actin Mediated Pathway This example describes fusosome delivery of Cre to a recipient cell via a dynamin mediated pathway. A fusosome comprising a microvesicle may be produced as described in the preceding example. Fusosomes are assayed for delivery of Cre via a dynamin-mediated pathway according to the preceding example, except that a group of recipient cells receiving fusosomes is treated with an inhibitor of dynamin, Dynasore (120 μM). To calculate the value of fusosome Cre delivered via a dynamin-mediated pathway, the level of fusosome Cre delivery in the presence of Dynasore (FusL+DS) is determined as well as the level of fusosome Cre delivery in the absence of Dynasore (FusL−DS). The normalized value of fusosome Cre delivered may be calculated as described in the preceding example.

This example also describes delivery of Cre to a recipient cell via macropinocytosis. A fusosome comprising a microvesicle may be produced as described in the preceding example. Fusosomes are assayed for delivery of Cre via macropinocytosis according to the preceding example, except that a group of recipient cells receiving fusosomes is treated with an inhibitor of macropinocytosis, 5-(N-ethyl-N-isopropyl)amiloride (EIPA) (25 μM). To calculate the value of fusosome Cre delivered via macropinocytosis, the level of fusosome Cre delivery in the presence of EIPA (FusL+EPIA) is determined as well as the level of fusosome Cre delivery in the absence of EPIA (FusL−EIPA). The normalized value of fusosome Cre delivered may be calculated as described in the preceding example.

This example also describes fusosome delivery of Cre to a recipient cell via an actin mediated pathway. A fusosome comprising a microvesicle may be produced as described in the preceding example. Fusosomes are assayed for delivery of Cre via macropinocytosis according to the preceding example, except that a group of recipient cells receiving fusosomes is treated with an inhibitor of actin polymerization, Latrunculin B (6 μM). To calculate the value of fusosome Cre delivered via an actin-mediated pathway, the level of fusosome Cre delivery in the presence of Latrunculin B (FusL+LatB) is determined as well as the level of fusosome Cre delivery in the absence of Latrunculin B (FusL−LatB). The normalized value of fusosome Cre delivered may be calculated as described in the preceding example.

Example 93: Delivery of Organelles

This example describes fusosome fusion with a cell in vitro. In some embodiments, fusosome fusion with a cell in vitro can result in delivery of fusosomal mitochondrial cargo to the recipient cell.

A fusosome produced by the methods described by the herein described methods was assayed for its ability to deliver its mitochondria to the recipient cell as follows.

In this particular example, the fusosome was a HEK293T cell expressing a fusogen protein on its membrane, as well as mitochondrial-targeted DsRED (mito-DsRED) protein to label mitochondria. The recipient cells were plated into a cell culture multi-well plate compatible with the imaging system to be used (in this example cells were plated in a glass-bottom imaging dish). The recipient cells stably-expressed cytosolic GFP.

Next, 24 hours after plating the recipient cells, the fusosome expressing mito-DsRED and possessing the particular fusogen protein was applied to the recipient cells in DMEM media. The dose of fusosomes was correlated to the number of recipient cells plated in the well. After applying the fusosomes the cell plate was centrifuged at 400 g for 5 minutes to help initiate contact between the fusosomes and the recipient cells. The cells were then incubated for 4 hours and VSVG-mediated fusion was induced by one minute exposure to pH 6.0 phosphate-buffered saline (or control cells are exposed to pH 7.4 phosphate-buffered saline). Following induction of fusion, cells were incubated an additional 16 hours and mitochondria delivery was assessed via imaging.

In this example, cells were imaged on a Zeiss LSM 710 confocal microscope with a 63× oil immersion objective while maintained at 37° C. and 5% CO2. GFP was subjected to 488 nm laser excitation and emission was recorded through a band pass 495-530 nm filter. DsRED was subjected to 543 nm laser excitation and emission was recorded through a band pass 560 to 610 nm filter. The cells were scanned to positively identify cells positive for cytosolic GFP fluorescence and mito-DsRED fluorescence.

The presence of both cytosolic GFP and mito-DsRED mitochondria were found in the same cell indicating the cell has undergone VSVG-mediated fusion, and thus mitochondria have been delivered from the fusosome to the recipient cell.

Example 94: In Vitro Delivery of DNA

This example describes the delivery of DNA using fusosomes to cells in vitro. This example quantifies the ability of fusosomes to deliver DNA using a plasmid encoding an exogenous gene, GFP, a surrogate therapeutic cargo.

A fusosome composition, resulting from cell-derived vesicles or cell-derived cytobiologics as produced by any one of the methods described in previous Examples, except the fusosome is engineered such that the fusogen is in-frame with the open reading frame of Cre. Following production of the fusosome, it is additionally nucleofected with a plasmid having a sequence that codes for GFP (System Biosciences, Inc.).

See, for example, Chen X, et al., Genes Dis. 2015 March; 2(1):96-105.DOI:10.1016/j.gendis.2014.12.001.

As a negative control, fusosomes are nucleofected with a plasmid having a sequence that codes for beta-actin.

A sufficient number of fusosomes are then incubated at 37° C. and 5% $CO_2$ together with a recipient NIH/3T3 fibroblast cell line that has a loxP-STOP-loxP-tdTomato reporter for a period of 48 h in in DMEM containing 20% Fetal Bovine Serum and 1× Penicillin/Streptomycin. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm. Total DNA is then isolated using a DNA extraction solution (Epicentre) and PCR is performed using primers specific to GFP (see Table 222) that amplify a 600 bp fragment. A 600 bp fragment present on a gel following gel electrophoresis would then substantiate the present of DNA delivery to the recipient cell.

TABLE 24

GFP Primers sequences that amplify a 500 bp fragment

| Primer | Sequence (SEQ ID NO) |
|---|---|
| GFP-F | ATGAGTAAAGGAGAAGAACTTTTCAC (SEQ ID NO: 600) |
| GFP-R | GTCCTTTTACCAGACAACCATTAC (SEQ ID NO: 601) |

In some embodiments, delivery of nucleic acid cargo with fusosomes in vitro is higher in fusosomes with GFP plasmid as compared to the negative control. Negligible GFP fluorescence is detected in the negative control.

Example 95: In Vivo Delivery of DNA

This example describes the delivery of DNA to cells in vivo via fusosomes. Delivery of DNA to cells in vivo results in the expression of proteins within the recipient cell.

Fusosome DNA delivery in vivo will demonstrates the delivery of DNA and protein expression in recipient cells within an organism (mouse).

Fusosomes that express a liver directed fusogen are prepared as described herein. Following production of the fusosome, it is additionally nucleofected with a plasmid having a sequence that codes for Cre recombinase.

Fusosomes are prepared for in vivo delivery. Fusosome suspensions are subjected to centrifugation. Pellets of the fusosomes are resuspended in sterile phosphate buffered saline for injection.

Fusosomes are verified to contain DNA using a nucleic acid detection method, e.g., PCR.

The recipient mice harbor a loxp-luciferase genomic DNA locus that is modified by CRE protein made from DNA delivered by the fusosomes to unblock the expression of luciferase (JAX #005125). The positive control for this example are offspring of recipient mice mated to a mouse strain that expresses the same protein exclusively in the liver from its own genome (albumin-CRE JAX #003574). Offspring from this mating harbor one of each allele (loxp-luciferase, albumin-CRE). Negative controls are carried out by injection of recipient mice with fusosomes not expressing fusogens or fusosomes with fusogens but not containing Cre DNA.

The fusosomes are delivered into mice by intravenous (IV) tailvein administration. Mice are placed in a commercially available mouse restrainer (Harvard Apparatus). Prior to restraint, animals are warmed by placing their cage on a circulating water bath. Once inside the restrainer, the animals are allowed to acclimate. An IV catheter consisting of a 30G needle tip, a 3" length of PE-10 tubing, and a 28G needle is prepared and flushed with heparinized saline. The tail is cleaned with a 70% alcohol prep pad. Then, the catheter needle is held with forceps and slowly introduced into the lateral tail vein until blood becomes visible in the tubing. The fusosome solution (~500K-5M fusosomes) is aspirated into a 1 cc tuberculin syringe and connected to an infusion pump. The fusosome solution is delivered at a rate of 20 μL per minute for 30 seconds to 5 minutes, depending on the dose. Upon completion of infusion, the catheter is removed, and pressure is applied to the injection site until cessation of any bleeding. Mice are returned to their cages and allowed to recover.

After fusion, the DNA will be transcribed and translated into CRE protein which will then translocates to the nucleus to carry out recombination resulting in the constitutive expression of luciferase. Intraperitoneal administration of D-luciferin (Perkin Elmer, 150 mg/kg) enables the detection of luciferase expression via the production of bioluminescence. The animal is placed into an in vivo bioluminescent imaging chamber (Perkin Elmer) which houses a cone anesthetizer (isoflurane) to prevent animal motion. Photon collection is carried out between 8-20 minutes post-injection to observe the maximum in bioluminescence due to D-luciferin pharmacokinetic clearance. A specific region of the liver is created in the software and collection exposure time set so that count rates are above 600 (in this region) to yield interpretable radiance (photons/sec/$cm^2$/steradians) measurements. The maximum value of bioluminescent radiance is recorded as the image of bioluminescence distribution. The liver tissue is monitored specifically for radiance measurements above background (untreated animals) and those of negative controls. Measurements are carried out at 24 hours post-injection to observe luciferase activity. Mice are then euthanized and livers are harvested.

Freshly harvested tissue is subjected to fixation and embedding via immersion in 4% paraformaldehyde/0.1M sodium phosphate buffer pH7.4 at 4° C. for 1-3 hrs. Tissue is then immersed in sterile 15% sucrose/1×PBS (3 hrs. to overnight) at 4° C. Tissue is then embedded in O.C.T. (Baxter No. M7148-4). Tissue is oriented in the block appropriately for sectioning (cross-section). Tissue is then frozen in liquid nitrogen using the following method: place the bottom third of the block into the liquid nitrogen, allow to freeze until all but the center of the O.C.T. is frozen, and allow freezing to conclude on dry ice. Blocks are sectioned by cryostat into 5-7 micron sections placed on slides and refrozen for staining.

In situ hybridization is carried out (using standard methods) on tissue sections using digoxygenin labeled nucleic acid probes (for CRE DNA and luciferase mRNA detection), labeled by anti-digoxygenin fluorescent antibodies, and observed by confocal microscopy.

In some embodiments, positive control animals (recombination via breeding without fusosome injection) will show bioluminescence intensity in liver as compared to untreated animals (no CRE and no fusosomes) and negative controls, while agent injected animals will show bioluminescence in liver as compared to negative controls (fusosomes without fusogen) and untreated animals.

In embodiments, detection of nucleic acid in tissue sections in agent injected animals will reveal detection of CRE recombinase and luciferase mRNA compared to negative controls and untreated animals in cells in the tissue, while positive controls will show levels of both luciferase mRNA and CRE recombinase DNA throughout the tissue.

Evidence of DNA delivery by fusosomes will be detected by in situ hybridization-based detection of the DNA and its colocalization in the recipient tissue of the animal. Activity of the protein expressed from the DNA will be detected by bioluminescent imaging. In embodiments, fusosomes will deliver DNA that will result in protein production and activity.

Example 96: In Vitro Delivery of mRNA

This example describes fusosome fusion with a cell in vitro. In some embodiments, fusosome fusion with a cell in vitro results in delivery of a specified mRNA to the recipient cell.

A fusosome produced by the herein described methods was assayed for its ability to deliver a specified mRNA to the recipient cell as follows. In this particular example, the fusosome was a cytobiologic (lacking a nucleus), which was generated from a 3T3 mouse fibroblast cell expressing Cre and GFP. The cytobiologic was then treated with HVJ-E fusogen protein to produce the fusosome.

The recipient mouse macrophage cells were plated into a cell culture multi-well plate compatible with the imaging system to be used (in this example cells are plated in a glass-bottom imaging dish). The recipient cells stably-expressed "LoxP-stop-LoxP-tdTomato" cassette under CMV promoter, which upon recombination by Cre induces tdTomato expression, indicating delivery of Cre protein to the recipient cell.

Next, 24 hours after plating the recipient cells, the fusosome expressing Cre recombinase protein and possessing the particular fusogen protein was applied to the recipient cells in DMEM media. The dose of fusosomes was correlated to the number of recipient cells plated in the well. After applying the fusosomes the cell plate was centrifuged at 400 g for 5 minutes to help initiate contact between the fusosomes and the recipient cells. The cells were then incubated for 16 hours and mRNA delivery was assessed via imaging.

The cells were stained with 1 μg/mL Hoechst 33342 in DMEM media for 10 minutes prior to imaging. In this example cells were imaged on a Zeiss LSM 710 confocal microscope with a 63× oil immersion objective while maintained at 37° C. and 5% CO2. Hoechst was subjected to 405 nm laser excitation and emission was recorded through a band pass 430-460 nm filter. GFP was subjected to 488 nm laser excitation and emission was recorded through a band pass 495-530 nm filter. tdTomato was subjected to 543 nm laser excitation and emission was recorded through a band pass 560 to 610 nm filter.

First, the cells were scanned to positively identify single-nucleated, tdTomato-positive cells. The presence of a tdTomato-positive cell indicated a cell that has undergone fusion, and the single nucleus indicated the fusion was by a cytobiologic fusosome donor. These identified cells were first imaged and then subsequently photo-bleached using a 488 nm laser to partially quench GFP fluorescence. The cells were then imaged over-time to assess recovery of GFP fluorescence, which would demonstrate translation of new GFP protein and thus presence of GFP mRNA delivered by the donor fusosome.

Analysis of Hoechst, GFP, and tdTomato fluorescence in the cells of interest was performed using ImageJ software (Rasband, W. S., ImageJ, U. S. National Institutes of Health, Bethesda, Maryland, USA, rsb.info.nih.gov/ij/, 1997-2007). First the images were pre-processed using a rolling ball background subtraction algorithm with a 60 μm width. Within a photo-bleached cell, the GFP fluorescence was thresholded to remove background. Then the GFP mean fluorescence intensity for the photo-bleached cell was analyzed at different times before and after photo-bleaching.

Figure 5:
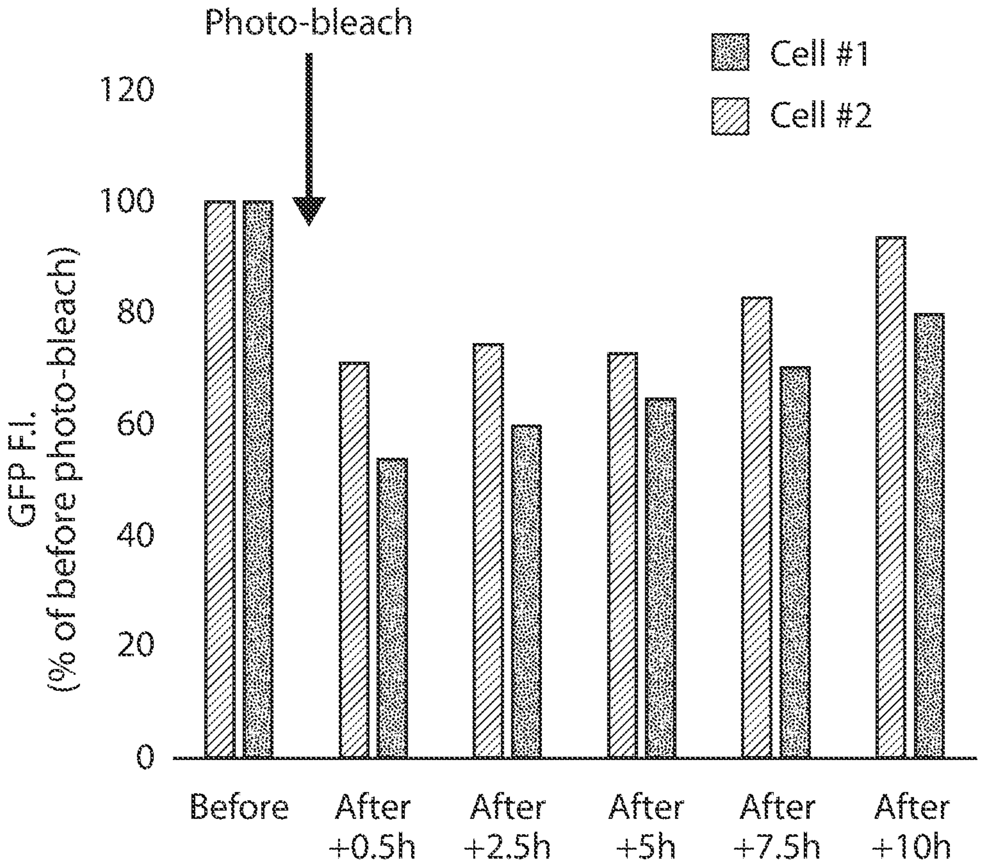
FIG. 5 is a graph showing recovery of GFP fluorescence after photobleaching of cells contacted with fusogens expressing Cre and GFP.

Within this particular Example, 3T3 mouse fibroblast cytobiologics expressing Cre and GFP and either possessing the applied fusogen HVJ-E (+fusogen) were applied to recipient mouse macrophage cells expressing "LoxP-stop-LoxP-tdTomato" cassette. Representative images and data are shown in FIG. 5. For this particular example the GFP fluorescence intensity recovered up to 25% of the original intensity 10 hours after photo-bleaching, indicating the delivery of actively-translated mRNA in the recipient cell.

Example 97: In Vitro Delivery of siRNA

This example describes delivery of short interfering RNA (siRNA) to cell in vitro via fusosomes. Delivery of siRNA to cells in vitro results in the suppression of the expression of proteins within the recipient cell. This can be used to inhibit the activity of a protein whose expression is injurious to the cell, thus permitting the cell to behave normally.

A fusosome produced by the herein described methods is assayed for its ability to deliver a specified siRNA to the recipient cell as follows. Fusosomes are prepared as described herein. Following production of the fusosome, it is additionally electroporated with an siRNA having a sequence that specifically inhibits GFP. The sequence of the double stranded siRNA targeted against GFP is 5' GACGUAAACGGCCACAAGUUC 3' (SEQ ID NO: 760) and its complement 3' CGCUGCAUUUGCCGGUGUUCA 5' (SEQ ID NO: 761) (note that there are overhangs 2 basepairs long at 3' ends of the siRNA sequence). As a negative control fusosomes are electroporated with an siRNA having a sequence that specifically inhibits luciferase. The sequence of the double stranded siRNA targeted against luciferase is 5' CUUACGCUGAGUACUUCGATT (SEQ ID NO: 762) 3' and its complement 3' TTGAAUGCGACUCAUGAAGCU 5' (SEQ ID NO: 763) (note that there are overhangs 2 basepairs long at 3' ends of the siRNA sequence).

The fusosomes are then applied to the recipient cells that constitutively express GFP. The recipient cells are plated into a black, clear-bottom 96-well plate. Next, 24 hours after plating the recipient cells, the fusosomes expressing are applied to the recipient cells in DMEM media. The dose of fusosomes is correlated to the number of recipient cells plated in the well. After applying the fusosomes, the cell plate is centrifuged at 400 g for 5 minutes to help initiate contact between the fusosomes and the recipient cells. The cells are then incubated for 16 hours and agent delivery, siRNA, is assessed via imaging.

The cells are imaged to positively identify GFP-positive cells in the field or well. In this example cell plates are imaged using an automated fluorescence microscope (www.biotek.com/products/imaging-microscopy-automated-cell-imagers/lionheart-fx-automated-live-cell-imager/). The total cell population in a given well is determined by first staining the cells with Hoechst 33342 in DMEM media for 10 minutes. Hoechst 33342 stains cell nuclei by intercalating into DNA and therefore is used to identify individual cells. After staining, the Hoechst media is replaced with regular DMEM media.

The Hoechst is imaged using the 405 nm LED and DAPI filter cube. GFP is imaged using the 465 nm LED and GFP filter cube. Images of the different cell groups are acquired by first establishing the LED intensity and integration times on an untreated well; i.e., recipient cells that were not treated with any fusosomes.

Acquisition settings are set so that GFP intensities are at the maximum pixel intensity values but not saturated. The wells of interest are then imaged using the established settings.

Analysis of GFP positive wells is performed with software provided with the fluorescence microscope or other software (Rasband, W. S., ImageJ, U. S. National Institutes of Health, Bethesda, Maryland, USA, http://rsb.info.nih.gov/ij/, 1997-2007). The images are pre-processed using a rolling ball background subtraction algorithm with a 60 μm width. The total cell mask is set on the Hoechst-positive cells. Cells with Hoechst intensity significantly above background intensities are thresholded and areas too small or large to be Hoechst-positive cells are excluded.

Within the total cell mask, GFP-positive cells are identified by again thresholding for cells significantly above background and extending the Hoechst (nuclei) masks for the entire cell area to include the entire GFP cellular fluorescence. The percentage of GFP-positive cells out of total cells is calculated.

In embodiments, the percentage of GFP positive cells in wells treated with fusosomes containing an siRNA against GFP will be at least 1%, 2%, 3%, 4%, 5%, 10%, 20%, 30%, 40%, 50%, 60%, 70%, 80%, 90% less than the percentage of GFP positive cells in well treated with fusosomes containing an siRNA against luciferase.

Example 98: In Vivo Delivery of mRNA

This example describes the delivery of messenger RNA (mRNA) to cells in vivo via fusosomes. In some embodiments, delivery of mRNA to cells in vivo results in the expression of proteins within the recipient cell. In some embodiments, this method of delivery can be used to supplement a protein not present due to a genetic mutation, permitting the cell to behave normally, or re-direct the activity of a cell to carry out a function, e.g., a therapeutic function.

In some embodiments, fusosome mRNA delivery in vivo demonstrates the delivery of messenger RNA and protein expression in recipient cells within an organism (e.g., a mouse).

In some embodiments, fusosomes that express a liver directed fusogen, and produce mRNA expressing Cre are prepared for in vivo delivery.

Fusosomes are prepared as described herein. Fusosome suspensions are subjected to centrifugation. Pellets of the fusosomes are resuspended in sterile phosphate buffered saline for injection.

Fusosomes are verified to express mRNA using a nucleic acid detection method, e.g., PCR.

The recipient mice harbor a loxp-luciferase genomic DNA locus that is modified by CRE protein made from mRNA delivered by the fusosomes to unblock the expression of luciferase (JAX #005125). The positive controls for this example are offspring of recipient mice mated to a mouse strain that expresses the same protein exclusively in the liver from its own genome (albumin-CRE JAX #003574). Offspring from this mating harbor one of each allele (loxp-luciferase, albumin-CRE). Negative controls are carried out by injection of recipient mice with fusosomes not expressing fusogens or fusosomes with fusogens but not expressing Cre mRNA.

The fusosomes are delivered into mice by intravenous (IV) tail vein administration. Mice are placed in a commercially available mouse restrainer (Harvard Apparatus). Prior to restraint, animals are warmed by placing their cage on a circulating water bath. Once inside the restrainer, the animals are allowed to acclimate. An IV catheter consisting of a 30G needle tip, a 3" length of PE-10 tubing, and a 28G needle is prepared and flushed with heparinized saline. The tail is cleaned with a 70% alcohol prep pad. Then, the catheter needle is held with forceps and slowly introduced into the lateral tail vein until blood becomes visible in the tubing. The fusosome solution (~500K-5M fusosomes) is aspirated into a 1 cc tuberculin syringe and connected to an infusion pump. The fusosome solution is delivered at a rate of 20 μL per minute for 30 seconds to 5 minutes, depending on the dose. Upon completion of infusion, the catheter is removed, and pressure is applied to the injection site until cessation of any bleeding. Mice are returned to their cages and allowed to recover.

After fusion, the mRNA is translated in the recipient cytoplasm into CRE protein which then translocates to the nucleus to carry out recombination resulting in the constitutive expression of luciferase. Intraperitoneal administration of D-luciferin (Perkin Elmer, 150 mg/kg) enables the detection of luciferase expression via the production of bioluminescence. The animal is placed into an in vivo bioluminescent imaging chamber (Perkin Elmer) which houses a cone anesthetizer (isoflurane) to prevent animal motion. Photon collection is carried out between 8-20 minutes post-injection to observe the maximum in bioluminescence due to D-luciferin pharmacokinetic clearance. A specific region of the liver is created in the software and collection exposure time set so that count rates are above 600 (in this region) to yield interpretable radiance (photons/sec/cm$^2$/steradians) measurements. The maximum value of bioluminescent radiance is recorded as the image of bioluminescence distribution. The liver tissue is monitored specifically for radiance measurements above background (untreated animals) and those of negative controls. Measurements are carried out at 24 hours post-injection to observe luciferase activity. Mice are then euthanized and livers are harvested.

Freshly harvested tissue is subjected to fixation and embedding via immersion in 4% paraformaldehyde/0.1M sodium phosphate buffer pH7.4 at 4° C. for 1-3 hrs. Tissue is then immersed in sterile 15% sucrose/1×PBS (3 hrs. to overnight) at 4° C. Tissue is then embedded in O.C.T. (Baxter No. M7148-4). Tissue is oriented in the block appropriately for sectioning (cross-section). Tissue is then frozen in liquid nitrogen using the following method: place the bottom third of the block into the liquid nitrogen, allow to freeze until all but the center of the O.C.T. is frozen, and allow freezing to conclude on dry ice. Blocks are sectioned by cryostat into 5-7 micron sections placed on slides and refrozen for staining.

In situ hybridization is carried out (using standard methods) on tissue sections using digoxygenin labeled RNA probes (for CRE mRNA and luciferase mRNA detection), labeled by anti-digoxygenin fluorescent antibodies, and observed by confocal microscopy.

In some embodiments, positive control animals (e.g., recombination via breeding without fusosome injection), will show bioluminescence intensity in liver as compared to untreated animals (e.g., no CRE or fusosomes), and negative controls. In some embodiments, fusosome injected animals will show bioluminescence in liver as compared to negative controls (e.g., fusosomes without fusogen), and untreated animals.

In some embodiments, detection of mRNA in tissue sections in animals administered fusosomes will reveal detection of CRE recombinase and luciferase mRNA compared to negative controls, and untreated animals in cells in the tissue. In some embodiments, positive controls will show levels of both luciferase mRNA and CRE recombinase mRNA throughout the tissue.

In some embodiments, evidence of mRNA delivery by fusosomes will be detected by in situ hybridization-based detection of the mRNA, and its colocalization in the recipient tissue of the animal. In some embodiments, activity of the protein expressed from the mRNA delivered by the fusosome is detected by bioluminescent imaging. In some embodiments, fusosomes deliver mRNA that will result in protein production and activity.

Example 99: In Vitro Delivery of Protein

This example demonstrates fusosome fusion with a cell in vitro. In this example, fusosome fusion with a cell in vitro results in delivery of Cre protein to the recipient cell.

In this example, the fusosomes were generated from a 3T3 mouse fibroblast cell possessing the Sendai virus HVJ-E protein (Tanaka et al., 2015, Gene Therapy, 22 (October 2014), 1-8. doi.org/10.1038/gt.2014.12). In addition, the fusosomes expressed Cre recombinase. The target cell was a primary HEK293T cell which stably-expressed "LoxP-GFP-stop-LoxP-RFP" cassette under a CMV promoter, which upon recombination by Cre switches from GFP to RFP expression, indicating fusion and Cre, as a marker, delivery.

Fusosomes produced by the herein described methods were assayed for the ability to deliver Cre protein to recipient cells as follows. The recipient cells were plated into a cell culture multi-well plate compatible with the imaging system to be used (in this example cells were plated in a black, clear-bottom 96-well plate). Next, 24 hours after plating the recipient cells, the fusosome expressing Cre recombinase protein and possessing the particular fusogen protein were applied to the recipient cells in DMEM media. The dose of fusosomes was correlated to the number of recipient cells plated in the well. After applying the fusosomes the cell plate was centrifuged at 400 g for 5 minutes to help initiate contact between the fusosomes and the recipient cells. The cells were then incubated for 16 hours and protein delivery was assessed via imaging.

The cells were imaged to positively identify RFP-positive cells versus GFP-positive cells in the field or well. In this example cell plates were imaged using an automated microscope. The total cell population in a given well was determined by first staining the cells with 1 μg/mL Hoechst 33342 in DMEM media for 10 minutes. Hoechst 33342 stains cell nuclei by intercalating into DNA and therefore is used to identify individual cells. After staining the Hoechst media was replaced with regular DMEM media. The Hoechst was imaged using the 405 nm LED and DAPI filter cube. GFP was imaged using the 465 nm LED and GFP filter cube, while RFP was imaged using 523 nm LED and RFP filter cube. Images of the different cell groups were acquired by first establishing the LED intensity and integration times on a positive-control well; i.e., cells treated with adenovirus coding for Cre recombinase. Acquisition settings were set so that RFP and GFP intensities are at the maximum pixel intensity values but not saturated. The wells of interest were then imaged using the established settings.

Analysis of Hoechst, GFP, and RFP-positive wells was performed in the Gen5 software provided with the LionHeart FX or by ImageJ software (Rasband, W. S., ImageJ, U. S. National Institutes of Health, Bethesda, Maryland, USA, http://rsb.info.nih.gov/ij/, 1997-2007). First the images were pre-processed using a rolling ball background subtraction algorithm with a 60 μm width. Next the total cell mask was set on the Hoechst-positive cells. Cells with Hoechst intensity significantly above background intensities were thresholded and areas too small or large to be Hoechst-positive cells were excluded. Within the total cell mask GFP and RFP-positive cells were identified by again thresholding for cells significantly above background and extending the Hoechst (nuclei) masks for the entire cell area to include the entire GFP and RFP cellular fluorescence.

The number of RFP-positive cells identified in control wells containing only recipient cells was used to subtract from the number of RFP-positive cells in the wells containing fusosome (to subtract for non-specific Loxp recombination). The number of RFP-positive cells (recipient cells that received the agent) was then divided by the sum of the GFP-positive cells (recipient cells that have not received the agent) and RFP-positive cells to quantify the fraction of fusosome agent delivery within the recipient cell population.

Figure 6:
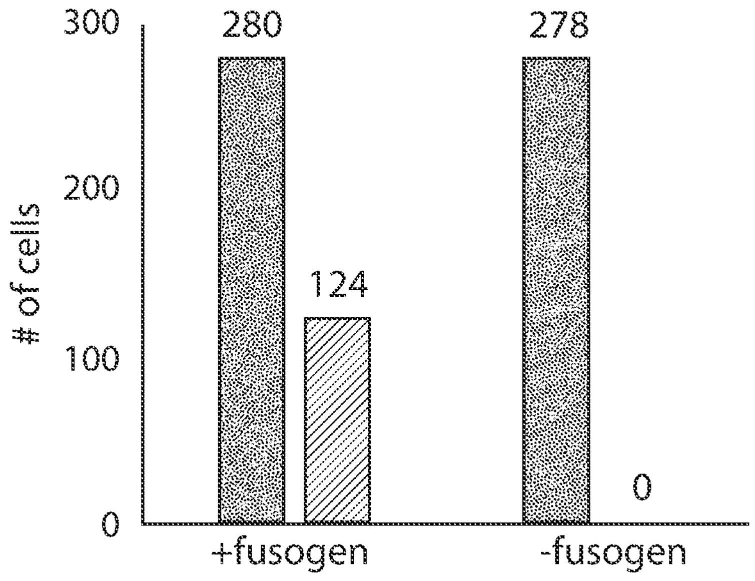
FIG. 6 is a graph showing the percentage of target cells expressing RFP after contacting with fusosomes or negative controls.

Within this particular example, 3T3 mouse fibroblast cells expressing Cre and either possessing the applied fusogen HVJ-E (+fusogen) or not (−fusogen) were applied to recipient 293T cells expressing "LoxP-GFP-stop-LoxP-RFP" cassette. Delivery of Cre protein is assessed by the induction of RFP expression in the recipient cells. The graph in FIG. 6 shows the quantification of the RFP-positive cells (rightmost bar of each pair) out of the total cells stained positive for Hoechst (leftmost bar of each pair). For this particular Example the fraction of fusosome delivery to recipient cells is 0.44 for 3T3 Cre cells possessing HVJ-E fusogen.

Example 100: In Vivo Delivery of Protein

This example describes the delivery of therapeutic agents to the eye by fusosomes.

Fusosomes are derived from hematopoietic stem and progenitor cells using any of the methods described in previous Examples and are loaded with a protein that is deficient in a mouse knock-out.

Fusosomes are injected subretinally into the right eye of a mouse that is deficient for the protein and vehicle control is injected into the left eye of the mice. A subset of the mice is euthanized when they reach 2 months of age.

Histology and H&E staining of the harvested retinal tissue is conducted to count the number of cells rescued in each retina of the mice (described in Sanges et al., The Journal of Clinical Investigation, 126(8): 3104-3116, 2016).

The level of the injected protein is measured in retinas harvested from mice euthanized at 2 months of age via a western blot with an antibody specific to the PDE6B protein.

In some embodiments, the left eyes of mice, which are administered fusosomes, will have an increased number of nuclei present in the outer nuclear level of the retina compared to the right eyes of mice, which are treated with vehicle. The increased protein is suggestive of complementation of the mutated PBE6B protein.

Example 101: Delivery to Edit Recipient DNA

This example describes fusosomes for delivery of genome CRISPR-Cas9 editing machinery to a cell in vitro. In some embodiments, delivery of genome CRISPR-Cas9 editing machinery to a cell in vitro via a fusosome results in a loss of function of a specific protein in a recipient cell. Genome editing machinery referred to, in this example, is the *S. pyogenes* Cas9 protein complexed with a guide RNA (gRNA) specific for GFP.

In some embodiments, fusosomes are a chassis for the delivery of therapeutic agents. In some embodiments, therapeutic agents, such as genome editing machinery that can be delivered to cells with high specificity and efficiency could be used to inactivate genes, and thus subsequent gene products (e.g. proteins) that when expressed at high levels or in the wrong cell type become pathological.

A fusosome composition as produced by any one of the methods described in previous Examples, except the fusosome is engineered such that the fusosome also includes the *S. pyogenes* Cas9 protein complexed with a guide RNA (gRNA) sequence that is specific for the sequence of A. Victoria EGFP. This is achieved by co-nucleofecting a PiggyBac vector that has the open reading frame of the Neomycin resistance gene that is an in-frame fusion with the open reading frame of *S. pyogenes* Cas9, separated by a P2A cleavage sequence. The additional co-nucleofected PiggyBac vector also includes the gRNA sequence (GAAGTTCGAGGGCGACACCC (SEQ ID NO: 764)) driven by the U6 promoter. As a negative control a fusosome is engineered such that the fusosome includes the *S. pyogenes* Cas9 protein complexed with a scrambled gRNA (GCACTACCAGAGCTAACTCA (SEQ ID NO: 765)) sequence that is not-specific for any target in the mouse genome.

A sufficient number of fusosomes are incubated at 37° C. and 5% $CO_2$ together with NIH/3T3 GFP+ cells for a period of 48 h in in DMEM containing 20% Fetal Bovine Serum and 1× Penicillin/Streptomycin. Following the 48 hr incubation, genomic DNA is prepared and used as a template with primers specific for region within 500 bp of the predicted gRNA cleavage site in the GFP gene (see Table 25).

TABLE 25

GFP Primers sequences that amplify a 500 bp fragment for TIDE analysis

| Primer | Sequence (SEQ ID NO) |
|---|---|
| GFP-F | ATGAGTAAAGGAGAAGAACTTTTCAC (SEQ ID NO: 602) |
| GFP-R | GTCCTTTTACCAGACAACCATTAC (SEQ ID NO: 603) |

The PCR amplicon is then purified, sequenced by capillary sequencing and then uploaded to Tide Calculator, a web tool that rapidly assesses genome editing by CRISPR-Cas9 of a target locus determined by a guide RNA. Based on the quantitative sequence trace data from two standard capillary sequencing reactions, the software quantifies the editing efficacy. An indel (insert or deletion) at the predicted gRNA cleavage site with the GFP locus results in the loss of GFP expression in the cells and is quantified via FACS using a FACS analysis (Becton Dickinson, San Jose, CA, USA) with 488 nm argon laser excitation and emission is collected at 530+/−30 nm. FACS software is used for acquisition and analysis. The light scatter channels are set on linear gains, and the fluorescence channels on a logarithmic scale, with a minimum of 10,000 cells analyzed in each condition. The indel and subsequent loss of GFP function is calculated based on the intensity of GFP signal in each sample.

In some embodiments, an indel (insert or deletion) at the predicted gRNA cleavage site with the GFP locus and loss of GFP fluorescence in the cell, in comparison to the negative control, will indicate the ability of a fusosome to edit DNA and result in a loss of protein function in vitro. In some embodiments, fusosomes with the scrambled gRNA sequence will demonstrate no indels or subsequent loss of protein function.

Example 102: Assessment of Teratoma Formation after Administration of Fusosome This Example describes the absence of teratoma formation with a fusosome. In some embodiments, a fusosome will not result in teratoma formation when administered to a subject.

Fusosomes are produced by any one of the methods described in a previous Example. Fusosomes, tumor cells (positive control) or vehicle (negative control) are subcutaneously injected in PBS into the left flank of mice (12-20 weeks old). Teratoma, e.g., tumor, growth is analyzed 2-3 times a week by determination of tumor volume by caliper measurements for eight weeks after fusosome, tumor cell, or vehicle injection.

In some embodiments, mice administered fusosomes or vehicle will not have a measurable tumor formation, e.g., teratoma, via caliper measurements. In some embodiments, positive control animals treated with tumor cells will demonstrate an appreciable tumor, e.g., teratoma, size as measured by calipers over the eight weeks of observation.

Example 103: Fusosomes Deliver Active Protein to Recipient Cells of a Subject In Vivo This Example demonstrates that fusosomes can deliver a protein to a subject in vivo. This is exemplified by delivery of the nuclear editing protein Cre. Once inside of a cell, Cre translocates to the nucleus, where it recombines and excises DNA between two LoxP sites. Cre-mediated recombination can be measured microscopically when the DNA between the two LoxP sites is a stop codon and is upstream of a distal fluorescent protein, such as the red fluorescent protein tdTomato.

Fusosomes that contain CRE and the fusogen VSV-G, purchased from Takara (Cre Recombinase Gesicles, Takara product 631449), were injected into B6.Cg-Gt(ROSA) $26Sor^{tm9(CAG\text{-}tdTomato)Hze}$/J mice (Jackson Laboratories strain 007909). Animals were injected at the anatomical sites, injection volumes, and injection sites as described in Table 26. Mice that do not have tdTomato (FVB.129S6(B6)-GT(ROSA)$26Sor^{tm1(Luc)Kael}$/J, Jackson Laboratories strain 005125) and were injected with fusosomes and B6.Cg-Gt (ROSA)$26Sor^{tm14(CAG\text{-}tdTomato)Hze}$/J mice that were not injected with fusosomes were used as negative controls.

TABLE 26

Injection parameters

| Anatomical Site | Injection Volume | Injection Site(s) |
|---|---|---|
| Brain | 10 µL | anterior posterior axis: −2 Lateral/medial axis: 1.8 ventral: 1.5 side: right |
| Eye | 1 µL | intravitreal |
| Liver | 25 µL | center of frontal lobe |
| Spleen | 10 µL | approximately in the center, both lengthwise and widthwise |
| Kidney | 20 µL | center of left kidney |
| Small intestine lining | 10 µL | loop of small intestine nearest the peritoneal wall was isolated outside peritoneum, and injected into lining. |
| Heart | 5 µL | near apex |
| White Adipose (Epididymal fat pad) | 25 µL | left, top and central |
| Brown adipose (intrascapular) | 25 µL | left lobe, as central as possible |
| Lung | 10 µL | inferior lobe right lung |
| Testis | 10 µL | left testis, as central as possible |
| Ovary | 1 µL | left ovary, as central as possible |

Two days after injections, the animals were sacrificed and samples were collected. The samples were fixed for 8 hours in 2% PFA, fixed overnight in 30% sucrose, and shipped for immediate embedding in OCT and sectioning to slides. Slides were stained for nuclei with DAPI. DAPI and tdTomato fluorescence was imaged microscopically.

Figure 9:
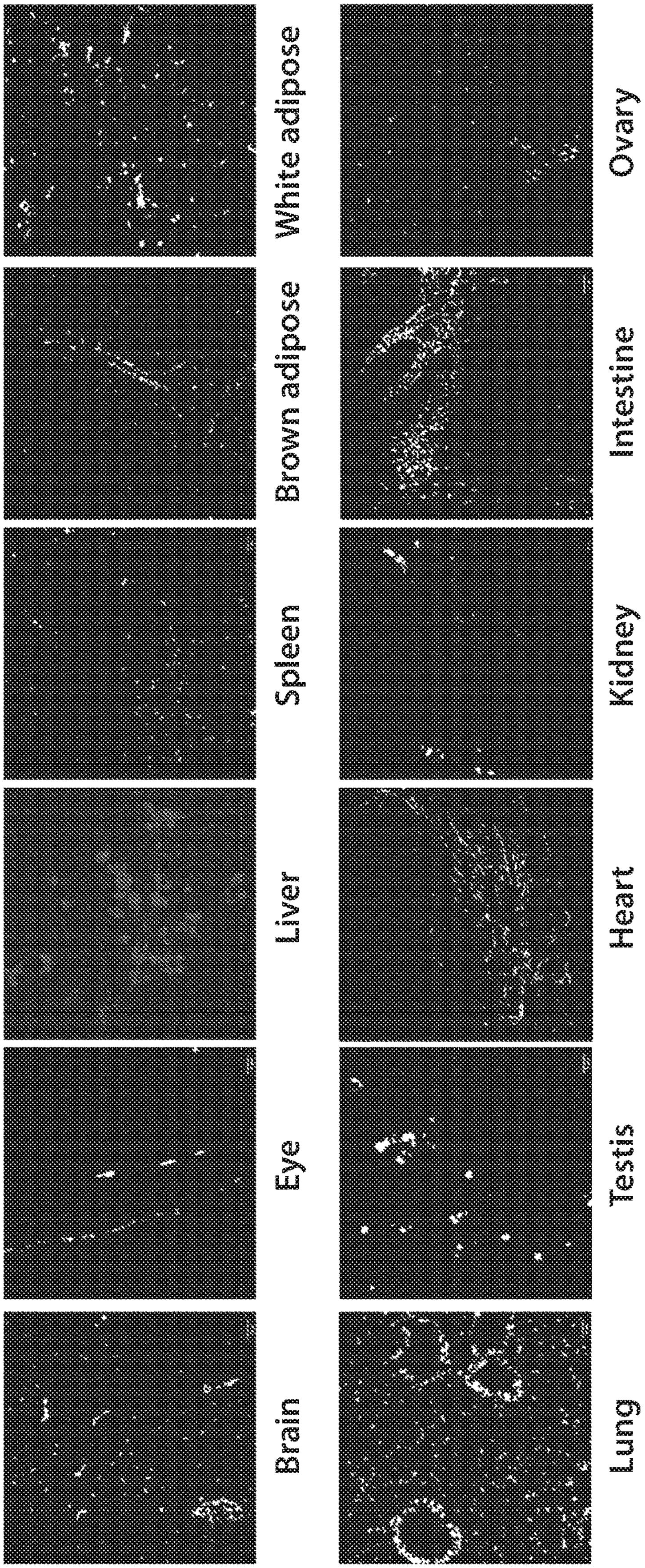
FIG. 9 shows microscopy images of the indicated tissues from mice injected with fusosomes. White indicates represent RFP-fluorescent cells, indicating delivery of a protein cargo to the cells in vivo.
Figure 11:
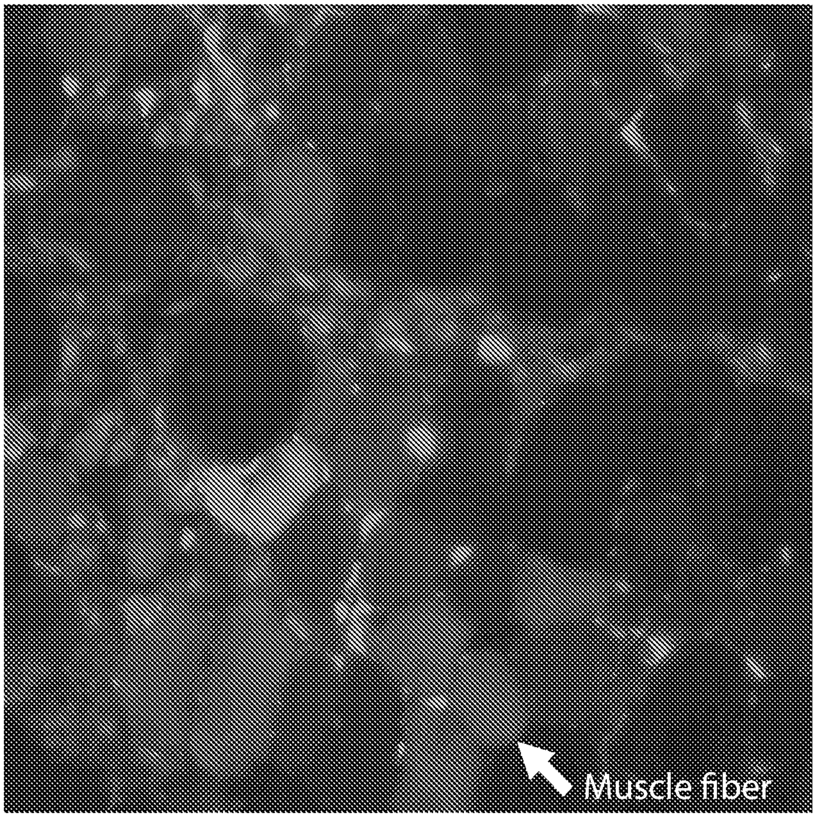
FIG. 11 shows microscopy images of tdTomato fluorescence in murine muscle tissue, indicating delivery of a protein cargo to muscle cells by cytobiologics.

All anatomical sites listed in Table 26 demonstrated tdTomato fluorescence (FIG. 9). In addition, delivery to muscle tissue was confirmed using fluorescence microscopy for tdTomato (FIG. 11). Negative control mice did not have any tissues with tdTomato fluorescence. This result demonstrates that fusosomes are capable of turning on tdTomato fluorescence in the cells of a mouse at various anatomical sites, and that this does not occur if the mice are not treated with fusosomes or if the mice do not have tdTomato in their genome. Hence, fusosomes deliver active Cre recombinase to the nucleus of mouse cells in vivo.

It was also shown that different routes of administration can deliver fusosomes to tissue in vivo. Fusosomes that contain CRE and the fusogen VSV-G, purchased from Takara (Cre Recombinase Gesicles, Takara product 631449), were injected into FVB.129S6(B6)-GT(ROSA) $26Sor^{tm1(Luc)Kael}$/J, (Jackson Laboratories strain 005125) intramuscularly (in 50 µL to the right tibialis anterior muscle), intraperitoneally (in 50 µL to the peritoneal cavity), and subcutaneously (in 50 µL under the dorsal skin).

The legs, ventral side, and dorsal skin was prepared for intramuscular, intraperitoneal, and subcutaneous injection, respectively, by depilating the area using a chemical hair remover for 45 seconds, followed by 3 rinses with water.

On day 3 after injection, an in vivo imaging system (Perkin Elmer) was used to obtain whole animal images of bioluminescence. Five minutes before imaging, mice received an intraperitoneal injection of bioluminescent substrate (Perkin Elmer) at a dose of 150 mg/kg in order to visualize luciferase. The imaging system was calibrated to compensate for all device settings.

Figure 10:
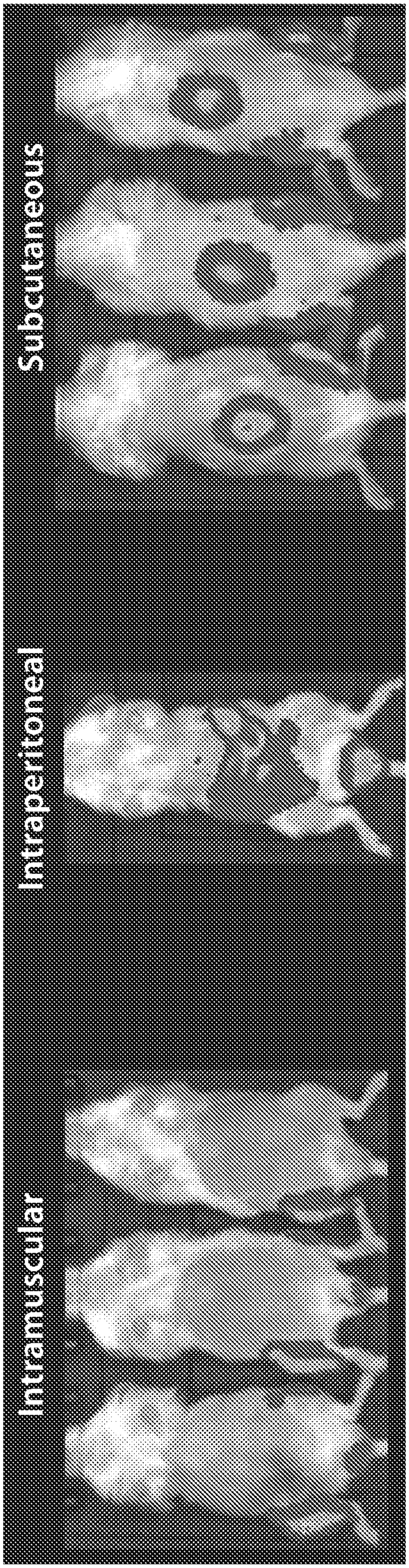
FIG. 10 is a series of images showing successful delivery of fusosomes to murine tissues in vivo by the indicated routes of administration, resulting in expression of luciferase by targeted cells.

Administration by all three routes resulted in luminescence (FIG. 10) indicating successful delivery of active Cre recombinase to mouse cells in vivo.

In conclusion, fusosomes are capable of delivering active protein to cells of a subject in vivo.

Example 104: Sonication-Mediated Loading of Nucleic Acid in Fusosomes

This example describes loading of nucleic acid payloads into a fusosome via sonication. Sonication methods are disclosed e.g., in Lamichhane, T N, et al., Oncogene Knockdown via Active Loading of Small RNAs into Extracellular Vesicles by Sonication. *Cell Mol Bioeng*, (2016), the entire contents of which are hereby incorporated by reference.

Fusosomes are prepared by any one of the methods described in a previous example. Approximately $10^6$ fusosomes are mixed with 5-20 µg nucleic acid and incubated at room temperature for 30 minutes. The fusosome/nucleic acid mixture is then sonicated for 30 seconds at room temperature using a water bath sonicator (Brason model #1510R-DTH) operated at 40 kHz. The mixture is then placed on ice for one minute followed by a second round of sonication at 40 kHz for 30 seconds. The mixture is then centrifuged at 16,000 g for 5 minutes at 4° C. to pellet the fusosomes containing nucleic acid. The supernatant containing unincorporated nucleic acid is removed and the pellet is resuspended in phosphate-buffered saline. After DNA loading, the fusosomes are kept on ice before use.

Example 105: Sonication-Mediated Loading of Protein in Fusosomes

This example describes loading of protein payloads into a fusosome via sonication. Sonication methods are disclosed e.g., in Lamichhane, T N, et al., Oncogene Knockdown via Active Loading of Small RNAs into Extracellular Vesicles by Sonication. *Cell Mol Bioeng*, (2016), the entire contents of which are hereby incorporated by reference.

Fusosomes are prepared by any one of the methods described in a previous example. Approximately $10^6$ fusosomes are mixed with 5-20 µg protein and incubated at room temperature for 30 minutes. The fusosome/protein mixture is then sonicated for 30 seconds at room temperature using a water bath sonicator (Brason model #1510R-DTH) operated at 40 kHz. The mixture is then placed on ice for one minute followed by a second round of sonication at 40 kHz for 30 seconds. The mixture is then centrifuged at 16,000 g for 5 minutes at 4° C. to pellet the fusosomes containing protein. The supernatant containing unincorporated protein is removed and the pellet is resuspended in phosphate-buffered saline. After protein loading, the fusosomes are kept on ice before use.

Example 106: Hydrophobic-Carrier Mediated Loading of Nucleic Acid in Fusosomes

This example describes loading of nucleic acid payloads into a fusosome via hydrophobic carriers. Exemplary methods of hydrophobic loading are disclosed, e.g., in Didiot et al., Exosome-mediated Delivery of Hydrophobically Modified siRNA for Huntingtin mRNA Silencing, *Molecular Therapy* 24(10): 1836-1847, (2016), the entire contents of which are hereby incorporated by reference.

Fusosomes are prepared by any one of the methods described in a previous example. The 3' end of a RNA molecule is conjugated to a bioactive hydrophobic conjugate (triethylene glycol—Cholesterol). Approximately $10^6$ fusosomes are mixed in 1 mL with 10 μmol/l of siRNA conjugate in PBS by incubation at 37° C. for 90 minutes with shaking at 500 rpm. The hydrophobic carrier mediates association of the RNA with the membrane of the fusosome. In some embodiments, some RNA molecules are incorporated into the lumen of the fusosome, and some are present on the surface of the fusosome. Unloaded fusosomes are separated from RNA-loaded fusosomes by ultracentrifugation for 1 hour at 100,000 g, 4° C. in a tabletop ultracentrifuge using a TLA-110 rotor. Unloaded fusosomes remain in the supernatant and RNA-loaded fusosomes form a pellet. The RNA-loaded fusosomes are resuspended in 1 mL PBS and kept on ice before use.

Example 107: Processing Fusosomes

This example described the processing of fusosomes. Fusosomes produced via any of the described methods in the previous Examples may be further processed.

In some embodiments, fusosomes are first homogenized, e.g., by sonication. For example, the sonication protocol includes a 5 second sonication using an MSE sonicator with microprobe at an amplitude setting of 8 (Instrumentation Associates, N.Y.). In some embodiments, this short period of sonication is enough to cause the plasma membrane of the fusosomes to break up into homogenously sized fusosomes. Under these conditions, organelle membranes are not disrupted and these are removed by centrifugation (3,000 rpm, 15 min 4° C.). Fusosomes are then purified by differential centrifugation as described in Example 16.

Extrusion of fusosomes through a commercially available polycarbonate membrane (e.g., from Sterlitech, Washington) or an asymmetric ceramic membrane (e.g., Membralox), commercially available from Pall Execia, France, is an effective method for reducing fusosome sizes to a relatively well defined size distribution. Typically, the suspension is cycled through the membrane one or more times until the desired fusosome size distribution is achieved. The fusosomes may be extruded through successively smaller pore membranes (e.g., 400 nm, 100 nm and/or 50 nm pore size) to achieve a gradual reduction in size and uniform distribution.

In some embodiments, at any step of fusosome production, though typically prior to the homogenization, sonication and/or extrusion steps, a pharmaceutical agent (such as a therapeutic), may be added to the reaction mixture such that the resultant fusosome encapsulates the pharmaceutical agent.

Example 108: Measuring Total RNA in a Fusosome and Source Cell

This Example describes a method to quantify the amount of RNA in a fusosome relative to a source cell. In some embodiments, a fusosome will have similar RNA levels to the source cell. In this assay, RNA levels are determined by measuring total RNA.

Fusosomes are prepared by any one of the methods described in previous Examples. Preparations of the same mass as measured by protein of fusosomes and source cells are used to isolate total RNA (e.g., using a kit such as Qiagen RNeasy catalog #74104), followed by determination of RNA concentration using standard spectroscopic methods to assess light absorbance by RNA (e.g. with Thermo Scientific NanoDrop).

In some embodiments, the concentration of RNA in fusosomes will be 5%, 10%, 20%, 30%, 40%, 50%, 60%, 70%, 80%, 90%, 95% of that of source cells per mass of protein.

Example 109: Fusosome Fusing to T Cell In Vitro a. DNA Payload

This example describes the delivery of DNA using fusosomes to CD3+ T cells in vitro. This example quantifies the ability of fusosomes to deliver DNA using a plasmid encoding an exogenous gene, a chimeric antigen receptor directed against CD19, which is a therapeutic cargo.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence. Following production of the fusosome, it is additionally nucleofected with a plasmid having a sequence that codes for the CAR.

See, for example, Chen X, et al., Genes Dis. 2015 March; 2(1):96-105.D01:10.1016/j.gendis.2014.12.001.

As a negative control, fusosomes are nucleofected with a plasmid that codes for GFP.

A sufficient number of fusosomes are then incubated at 37° C. and 5% CO2 together with recipient CD3+ T cells that have a loxP-STOP-loxP-tdTomato reporter for a period of 48 h in T-cell medium comprising X-VIVO 15 medium (Lonza, Basel, CH, Switzerland) supplemented with 5% fetal bovine serum (FBS) (Gibco, LAX, CA, USA), 100 U mL-1 penicillin, 100 μg mL-1 streptomycin, 1.25 μg mL-1 amphotericin B, 2 mM L-glutamine (Gibco), and 100 U mL-1 hIL-2 (PerproTech, Rocky Hill, CT, USA). Fusosome fusion with the CD3+ T cells that have have a loxP-STOP-loxP-tdTomato reporter results in tdTomato expression due to Cre recombinase excising from DNA the stop codon that blocks tdTomato expression. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm. Total DNA is then isolated using a DNA extraction solution (Epicentre). Quantitative Real-time PCR is performed using a QuantStudio3 Real-time PCR System (ThermoFisher Scientific) with TaqMan® Fast Advanced Master Mix (ThermoFisher Scientific), 100 ng of DNA template, a primer and probe set that is specific for the variable regions of the anti-CD19 CAR (designed using Taqman online primer and probe design program). cA standard curve is prepared for absolute quantitation of anti-CD19 CAR transgene DNA copies by making serial dilutions of the plasmid that encodes the CAR. A primer and probe set specific for beta-lactamase (AMP' gene) was used to normalize for DNA quantity. The $C_t$ value is used to compare the amount of CAR DNA in the CD3+ T cells treated with fusosomes with CAR plasmid or with negative control.

In some embodiments, delivery of DNA cargo with fusosomes in vitro is higher in fusosomes with CAR plasmid as compared to the negative control.

b. mRNA Payload

This example describes the delivery of mRNA using fusosomes to CD3+ T cells in vitro. This example quantifies the ability of fusosomes to deliver mRNA encoding an exogenous gene, a chimeric antigen receptor directed against CD19, which is a therapeutic cargo.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence. Following production of the fusosome, it is additionally nucleofected with an mRNA having a sequence that codes for the CAR. See, for example, Chen X, et al., Genes Dis. 2015 March; 2(1):96-105.DOI: 10.1016/j.gendis.2014.12.001.

As a negative control, fusosomes are nucleofected with an mRNA that codes for GFP.

A sufficient number of fusosomes are then incubated at 37° C. and 5% CO2 together with recipient CD3+ T cells that have a loxP-STOP-loxP-tdTomato reporter for a period of 48 h in T-cell medium comprising X-VIVO 15 medium (Lonza, Basel, CH, Switzerland) supplemented with 5% fetal bovine serum (FBS) (Gibco, LAX, CA, USA), 100 U mL-1 penicillin, 100 μg mL-1 streptomycin, 1.25 μg mL-1 amphotericin B, 2 mM L-glutamine (Gibco), and 100 U mL-1 hIL-2 (PerproTech, Rocky Hill, CT, USA). Fusosome fusion with the CD3+ T cells that have a loxP-STOP-loxP-tdTomato reporter results in tdTomato expression due to Cre recombinase excising from DNA the stop codon that blocks tdTomato expression. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm.

Total RNA is isolated (e.g., using a kit such as Qiagen RNeasy catalog #74104), followed by determination of RNA concentration using standard spectroscopic methods to assess light absorbance by RNA (e.g. with Thermo Scientific NanoDrop). Reverse transcription is performed using the Superscript III First-Strand Synthesis supermix for RT-PCR (Thermo Fisher Scientific), and RNA (100 ng) is reverse transcribed into cDNA. Quantitative Real-time PCR is performed using a QuantStudio3 Real-time PCR System (ThermoFisher Scientific) with TaqMan® Fast Advanced Master Mix (ThermoFisher Scientific), 100 ng of cDNA template, a primer and probe set that is specific for the variable regions of the anti-CD19 CAR (designed using Taqman online primer and probe design program), and primer probe set designed to amplify (β-actin as an endogenous loading control. The $C_t$ value is used to compare the amount of CAR cDNA in the qRT-PCR reaction between CD3+ T cells treated with fusosomes containing the CAR mRNA and treated with fusosomes containing negative control. The relative expression is calculated using the ΔΔCt method. A higher relative expression level of CAR is due to a higher level of CAR mRNA that is purified from the sorted CD3+ T cells.

In some embodiments, delivery of mRNA cargo with fusosomes in vitro is higher in fusosomes containing CAR mRNA as compared to negative control fusosomes.

c. Protein/mRNA Payload, Wherein Payload is Expressed by Donor Cell

This example describes fusosome fusion with a cell in vitro. In some embodiments, fusosome fusion with a CD3+ T cell in vitro results in delivery of a chimeric antigen receptor protein to the membrane of the CD3+ T cell.

A fusosome composition, resulting from cell-derived vesicles or cell-derived cytobiologics as produced by any one of the methods described in previous Examples, except the fusosome is engineered such that the fusogen is in-frame with the open reading frame of Cre and with the open reading frame of a CAR that targets CD19, separated by a P2A and T2A self-cleaving peptide sequence respectively. A negative control fusosome is engineered such that the fusogen is in-frame with the open reading frame of Cre and with the open reading frame of the blue fluorescent protein mTagBFP2, each separated by a P2A self-cleaving peptide sequence. See, for example, Chen X, et al., Genes Dis. 2015 March; 2(1):96-105.DOI:10.1016/j.gendis.2014.12.001.

A sufficient number of fusosomes are then incubated at 37° C. and 5% CO2 together with recipient CD3+ T cells that have a loxP-STOP-loxP-tdTomato reporter for a period of 48 h in T-cell medium comprising X-VIVO 15 medium (Lonza, Basel, CH, Switzerland) supplemented with 5% fetal bovine serum (FBS) (Gibco, LAX, CA, USA), 100 U mL-1 penicillin, 100 μg mL-1 streptomycin, 1.25 μg mL-1 amphotericin B, 2 mM L-glutamine (Gibco), and 100 U mL-1 hIL-2 (PerproTech, Rocky Hill, CT, USA. Fusosome fusion with the CD3+ T cells that have a loxP-STOP-loxP-tdTomato reporter results in tdTomato expression due to Cre recombinase excising from DNA the stop codon that blocks tdTomato expression. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm.

mRNA delivery to the sorted T cells is assayed. Total RNA is isolated (e.g., using a kit such as Qiagen RNeasy catalog #74104), followed by determination of RNA concentration using standard spectroscopic methods to assess light absorbance by RNA (e.g. with Thermo Scientific NanoDrop). Reverse transcription is performed using the Superscript III First-Strand Synthesis supermix for RT-PCR (Thermo Fisher Scientific), and RNA (100 ng) is reverse transcribed into cDNA. Quantitative Real-time PCR is performed using a QuantStudio3 Real-time PCR System (ThermoFisher Scientific) with TaqMan® Fast Advanced Master Mix (ThermoFisher Scientific), 100 ng of cDNA template, a primer and probe set that is specific for the variable regions of the anti-CD19 CAR (designed using Taqman online primer and probe design program), and primer probe set designed to amplify β-actin as an endogenous loading control. The $C_t$ value is used to compare the amount of CAR cDNA in the qRT-PCR reaction between CD3+ T cells treated with fusosomes containing the CAR mRNA and treated with fusosomes containing negative control. The relative expression is calculated using the ΔΔCt method. A higher relative expression level of CAR is due to a higher level of CAR mRNA that is purified from the sorted CD3+ T cells.

In some embodiments, delivery of the CAR mRNA cargo with fusosomes in vitro is higher in fusosomes derived from cells expressing the CAR as compared to the negative control fusosomes derived from cells expressing CFP.

CAR expression on the surface of the sorted cells is assayed. Sorted tdTomato+CD3+ cells are incubated with CD19sIg1-4 conjugated to Alexa Fluor 488 (CD19sIg1-4:

AF488), as described in De Oliveira et al., J Transl Med 11:23, 2013. CD19sIg1-4:AF488 labels cells that express CD19 CAR. $2\times10^5$ cells are incubated with 450 ng of CD19sIg1-4:AF488 at 4° C. for 30 minutes in the dark, after being blocked by human serum from AB plasma (Sigma-Aldrich) for 10 minutes. After being washed two times with PBS, cells are analyzed on a LSR II (BD Biosciences, San Jose, CA) machine running the FACSDiva™ software (BD Biosciences, San Jose, CA.). tdTomato+CD3+ cells that were incubated with the negative control fusogen are used to set up the negative gate for CD19sIg1-4:AF488 signal. The gate is chosen such that % of positive events for CD19sIg1-4:AF488 is equal to 0.0% The percent of events that are positive for CD19sIg1-4:AF488 is measured in sorted cells that were treated with fusosomes derived from cells expressing the CAR.

In some embodiments, the percent of sorted cells with surface CAR expression is higher in cells treated with fusosomes derived from cells expressing the CAR as compared to the negative control fusosomes derived from cells expressing mTagBFP2.

Example 110: T-Cell Specific Fusosome Fusing to T Cell In Vitro

This example describes fusosome fusion that is preferential for a CD3+ T cell in vitro. In some embodiments, the fusosome delivers its payload to a CD3+ T cell at a greater efficiency than an alternative cell type.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence.

A sufficient number of fusosomes are then incubated at 37° C. and 5% CO2 together with recipient CD3+ T cells that have a loxP-STOP-loxP-tdTomato reporter for a period of 48 h in T-cell medium comprising X-VIVO 15 medium (Lonza, Basel, CH, Switzerland) supplemented with 5% fetal bovine serum (FBS) (Gibco, LAX, CA, USA), 100 U mL-1 penicillin, 100 m mL-1 streptomycin, 1.25 μg mL-1 amphotericin B, 2 mM L-glutamine (Gibco), and 100 U mL-1 hIL-2 (PerproTech, Rocky Hill, CT, USA. Fusosome fusion with the CD3+ T cells that have a loxP-STOP-loxP-tdTomato reporter results in tdTomato expression due to Cre recombinase excising from DNA the stop codon that blocks tdTomato expression.

In a separate experiment, the same number of fusosomes are incubated at 37° C. and 5% $CO_2$ together with a recipient NIH/3T3 fibroblast cell line that has a loxP-STOP-loxP-tdTomato reporter for a period of 48 h in in DMEM containing 20% Fetal Bovine Serum and 1× Penicillin/Streptomycin. Fusosome fusion with the NIH/3T3 fibroblasts that have a loxP-STOP-loxP-tdTomato reporter results in tdTomato expression due to Cre recombinase excising from DNA the stop codon that blocks tdTomato expression.

Following the 48 hr incubations, cells are run on a FACS cytometer (Becton Dickinson, San Jose, CA, USA) with 561 nm laser excitation and emission collected at 590+/−20 nm. A gate is set up to measure positive tdTomato expression. The gate is chosen such that CD3+ T cells and NIH/3T3 fibroblasts that have not been contacted with fusosomes are all negative. The percent of cells that are positive for tdTomato expression is measured in CD3+ T cells and NIH/3T3 fibroblasts that have been contacted by fusosomes.

In some embodiments, a percent of cells that are positive for tdTomato expression is higher in CD3+ cells contacted with fusosomes than in NIH/3T3 fibroblasts contacted with fusosomes, which demonstrates that fusosomes fuse preferentially with the target CD3+ cells.

Example 111: T-Cell Specific Fusosome Fusing to T Cell In Vivo

This example describes fusosome fusion that is preferential for a CD3+ T cell in vivo. In some embodiments, a fusosome delivers its payload to a CD3+ T cell at a greater efficiency than any alternative cell type.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence.

$3\times10^{11}$ fusosomes or PBS are then administered slowly over 20 min through a rodent tail-vein catheter using a programmable BS-300 infusion pump (both Braintree Scientific Inc.) daily for 5 days to B6.Cg-Gt(ROSA) $26Sor^{tm9(CAG\text{-}tdTomato)Hze}$/J mice (Jackson Laboratories strain 007909). Three days after the final treatment, peripheral blood is collected from fusosome treated mice and mice that received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD3-FITC antibody (Thermo Fisher Catalog #:11-0032-82), at 4° C. for 30 minutes in the dark, after being blocked with bovsine serum albumin for 10 minutes. After being washed two times with PBS, cells are analyzed on a LSR II (BD Biosciences, San Jose, CA.) with 488 nm laser excitation and emission collected at 530+/−30 nm running the FACS-Diva™ software (BD Biosciences, San Jose, CA.). Unstained cells from mice that received PBS treatment are used to draw a gate for negative FITC and negative tdTomato fluorescence.

In some embodiments, a percent of cells that are positive for tdTomato fluorescence is higher in mice treated with fusosomes than in mice treated with PBS. In some embodiments, a percent of tdTomato positive cells that stain positive for FITC is greater than those that stain negative for FITC in mice treated with fusosomes. This demonstrates that fusosomes targeting CD3+ cells specifically fuse with CD3+ cells in vivo.

Example 112: T Cells Engineered In Vitro Lyse Cells Associated with a Target Antigen in Vitro This example demonstrates that CD3+ T cells expressing a CAR after being contacted by a fusosome as described in any one of the methods in previous Examples are capable of lysing cells associated with a target antigen, e.g., CD19, in vitro.

CD3+ T cells expressing a CAR targeting CD19 are incubated with CD19+ Eμ-ALL01 leukaemia cells (target) or CD19-B16F10 melanoma tumor cells (control). Prior to the incubation, the CD3+ T cells are activated using CD3- and CD28-specific magnetic beads at three beads/cell (Invitrogen Life Technologies, Carlsbad, CA, USA and the Eμ-ALL01 leukaemia cells and B16F10 melanoma tumor cells are labeled with membrane dye PKH-26 (Sigma-Aldrich), washed with RPMI containing 10% foetal calf serum, and resuspended in the same medium at a concentration of $1\times10^5$ tumor cells per mL. T cells are then added to the suspension at various ratios of T cell to tumor cell, ranging from 0 T cells: 1 tumor cells to 100 T cells: 1 tumor cells, in 96-well plates (final volume, 200 μl), and incubated for 3 h at 37° C. Then, cells are transferred to V-bottom 96-well plates and stained with Annexin V-Brilliant Violet 421 (BioLegend). Following a wash in PBS, the cells are analyzed by flow cytometry on a LSR II (BD Biosciences, San Jose, CA.) machine running the FACSDiva™ software (BD Biosciences, San Jose, CA.). Cells from the incubation of 0 T cells: 1 tumor cells and a separate batch of T cells are first run on the flow cytometer. A gate is first drawn to distinguish T cells and tumor cells based upon PKH-26 fluorescence. The gate is drawn such that T cells are negative and tumor cells that were incubated with PKH-26 are positive. Next, a gate is drawn to measure Annexin V-Brilliant Violet 421 staining. The gate is drawn such that the cells from the incubation of 0 T cells: 1 tumor cells are all negative for Annexin V-Brilliant Violet 421. Using these two gates, cells from each of the incubations of various ratios of T cells to tumor cells are run on the flow cytometer.

In some embodiments, a percent of cells that are positive for PKH-26 and Annexin V-Brilliant Violet 421 increases with increasing ratios of T cells to tumor cells for the Eμ-ALL01 leukaemia cells, and the percent of cells that are positive for PKH-26 and Annexin V-Brilliant Violet 421 does not increase with increasing ratios of T cells to tumor cells for the B16F10 melanoma tumor cells. This demonstrates that T cells that express a CAR targeting CD19 after being contacted by fuses are capable of specifically lysing cells that are CD19-positive.

See, for example, Smith T, et al., Nature Nanotechnology. 2017. DOI: 10.1038/NNANO.2017.57

Example 113: T Cells Engineered In Vivo Lyse Cells Associated with a Target Antigen in Vitro This example demonstrates that CD3+ T cells engineered to express a CAR after being contacted by a fusosomes in vivo are capable of lysing cells associated with a target antigen in vitro.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence. In addition, the fusosome is engineered to deliver a CAR targeting CD-19 to a target cell as described in previous Examples.

$3\times10^{11}$ fusosomes or PBS are then administered slowly over 20 min through a rodent tail-vein catheter using a programmable BS-300 infusion pump (both Braintree Scientific Inc.) daily for 5 days to B6.Cg-Gt(ROSA) 26Sor$^{tm9(CAG\text{-}tdTomato)Hze}$/J mice (Jackson Laboratories strain 007909). Three days after the final treatment, peripheral blood is collected from fusosome treated mice and mice received PBS treatment. Blood is collected into 1 ml PBS containing 5 μM EDTA and mixed immediately to prevent clotting. The tubes are kept on ice and red blood cells are removed using a buffered ammonium chloride (ACK) solution. Cells are stained with a murine CD3-FITC antibody (Thermo Fisher Catalog #:11-0032-82), at 4° C. for 30 minutes in the dark, after being blocked with bovsine serum albumin for 10 minutes. After being washed two times with PBS, cells are analyzed on a LSR II (BD Biosciences, San Jose, CA.) with 488 nm laser excitation and emission collected at 530+/−30 nm running the FACSDiva™ software (BD Biosciences, San Jose, CA.). Sorted cells from mice treated with fusosomes or PBS are then incubated with CD19+Eμ-ALL01 leukaemia cells. Prior to the incubation, Eμ-ALL01 leukaemia cells are labeled with membrane dye PKH-26 (Sigma-Aldrich), washed with RPMI containing 10% foetal calf serum, and resuspended in the same medium at a concentration of $1\times10^5$ tumor cells per mL. T cells are then added to the suspension at various ratios of T cell to tumor cell, ranging from 0 T cells: 1 tumor cells to 100 T cells: 1 tumor cells, in 96-well plates (final volume, 200 μl), and incubated for 3 h at 37° C. Then, cells are transferred to V-bottom 96-well plates and stained with Annexin V-Brilliant Violet 421 (BioLegend). Following a wash in PBS, the cells are analyzed by flow cytometry on a LSR II (BD Biosciences, San Jose, CA.) machine running the FACSDiva™ software (BD Biosciences, San Jose, CA.). Cells from the incubation of 0 T cells: 1 tumor cells and a separate batch of sorted T cells are first run on the flow cytometer. A first gate is first drawn to distinguish T cells and tumor cells based upon PKH-26 fluorescence. The gate is drawn such that T cells are negative and tumor cells that were incubated with PKH-26 are positive. Next, a gate is drawn to measure Annexin V-Brilliant Violet 421 staining. The gate is drawn such cells from the incubation of 0 T cells: 1 tumor cells are all negative for Annexin V-Brilliant Violet 421. Using these two gates, cells from each of the incubations of various ratios of T cells to tumor cells are run on the flow cytometer.

In some embodiments, a percent of cells that are positive for PKH-26 and Annexin V-Brilliant Violet 421 increases with increasing ratios of T cells to Eμ-ALL01 leukaemia cells from mice treated with fusosomes, and the percent of cells that are positive for PKH-26 and Annexin V-Brilliant Violet 421 does not increase with increasing ratios of T cells to Eμ-ALL01 leukaemia cells from mice treated with PBS. This demonstrates that T cells engineered to express a CAR that targets CD19 after treatment with fusosomes are capable of lysing cells associated with CD19. See, for example, Smith T, et al., Nature Nanotechnology. 2017. DOI: 10.1038/NNANO.2017.57

Example 114: T Cells Engineered In Vivo Lyse Tumor Cells Associated with a Target Antigen In Vivo This example demonstrates that CD3+ T cells engineered to express a CAR after being contacted by a fusosomes in vivo are capable of treating a tumor in vivo.

A fusosome composition, resulting from cell-derived vesicles or cell-derived cytobiologics as produced by any one of the methods described in previous Examples, except the fusosome is engineered such that the fusogen is in-frame with the open reading frame of Cre but separated by a P2A self-cleaving peptide sequence. In addition, the fusosome is engineered to deliver a CAR targeting CD-19 as described in previous Examples.

A model of leukemia is established by systemically injecting luciferase-expressing Eμ-ALL01 leukaemia cells into 4-6-week-old female albino B6 (C57BL/6J-Tyr<c-2J>) mice (Jackson Laboratories) and allowing them to develop for 1 week. Mice are then randomly assigned to experimental cohorts. $3\times10^{11}$ fusosomes or PBS are then administered slowly over 20 min through a rodent tail-vein catheter using a programmable BS-300 infusion pump (both Braintree Scientific Inc.) daily for 5 days.

Luminescence as a proxy for the number of live leukemia cells is then measured daily. D-luciferin (Xenogen) in PBS (15 mg mL-1) is used as a substrate for F-luc expressed by the leukemia cells. Bioluminescence images are collected with a Xenogen IVIS Spectrum Imaging System (Xenogen). Living Image software version 4.3.1 (Xenogen) is used to acquire (and later quantitate) the data obtained over a range of 10-35 min after intraperitoneal injection of D-luciferin into animals anesthetized with 150 mg kg-1 of 2% isoflurane (Forane, Baxter Healthcare). Acquisition times range from 10 s to 5 min. To correct for background bioluminescence, the signals acquired from tumor-free mice (injected with D-luciferin) is subtracted from the measurement region of interest (ROI).

In embodiments, the luciferase signal increases over the course of 21 days in mice treated with PBS and the luciferase signal decreases over the course of 21 days in mice treated with fusosomes.

The survival of mice that received PBS or fusosomes is also tracked. In embodiments, mice that received PBS have a median survival that is less than mice treated with fusosomes.

This demonstrates that fusosomes are capable of engineering T cells to target tumor cells in vivo. See, for example, Smith T, et al., Nature Nanotechnology. 2017. DOI: 10.1038/NNANO.2017.57

Example 115: Fusosomes Deliver a Transmembrane Protein to Recipient Cells

This example describes fusosome fusion with a cell in vitro. In some embodiments, fusosome fusion results in delivery of a transmembrane protein to a recipient cell.

A fusosome composition, resulting from cell-derived vesicles or cell-derived cytobiologics as produced by any one of the methods described in previous Examples, except the fusosome is engineered such that the fusogen is in-frame with the open reading frame of Cre and with the open reading frame of the human Insulin Receptor, separated by a P2A and T2A self-cleaving peptide sequence respectively. A negative control fusosome is engineered such that the fusogen is in-frame with the open reading frame of Cre and with the open reading frame of the blue fluorescent protein mTagBFP2, each separated by a P2A self-cleaving peptide sequence. See, for example, Chen X, et al., Genes Dis. 2015 March; 2(1):96-105.DOI:10.1016/j.gendis.2014.12.001.

A sufficient number of fusosomes are then incubated at 37° C. and 5% CO2 together with recipient HEK293 cells that have a loxP-STOP-loxP-tdTomato reporter for a period of 48 h in complete media (DMEM+10% FBS+Pen/Strep). Fusosome fusion with the HEK293 cells that have a loxP-STOP-loxP-tdTomato reporter results in tdTomato expression due to Cre recombinase excising from DNA the stop codon that blocks tdTomato expression. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm.

mRNA delivery to the sorted HEK293 cells is assayed. Total RNA is isolated (e.g., using a kit such as Qiagen RNeasy catalog #74104), followed by determination of RNA concentration using standard spectroscopic methods to assess light absorbance by RNA (e.g. with Thermo Scientific NanoDrop). Reverse transcription is performed using the Superscript III First-Strand Synthesis supermix for RT-PCR (Thermo Fisher Scientific), and RNA (100 ng) is reverse transcribed into cDNA. Quantitative Real-time PCR is performed using a QuantStudio3 Real-time PCR System (ThermoFisher Scientific) with TaqMan® Fast Advanced Master Mix (ThermoFisher Scientific), 100 ng of cDNA template, a primer and probe set that is specific for the variable regions of the human Insulin Receptor (designed using Taqman online primer and probe design program), and primer probe set designed to amplify β-actin as an endogenous loading control. The $C_t$ value is used to compare the amount of Insulin Receptor cDNA in the qRT-PCR reaction between HEK293 cells treated with fusosomes containing the Insulin Receptor mRNA and treated with fusosomes containing negative control. The relative expression is calculated using the ΔΔCt method. A higher relative expression level of Insulin Receptor is due to a higher level of Insulin Receptor mRNA that is purified from the sorted HEK293 T cells.

In some embodiments, delivery of the Insulin Receptor mRNA cargo with fusosomes in vitro is higher in fusosomes derived from cells expressing the Insulin Receptor as compared to the negative control fusosomes derived from cells expressing CFP.

Insulin Receptor expression on the surface of the sorted cells is assayed. Sorted tdTomato+HEK293 cells are incubated with Insulin Receptor Alpha Antibody conjugated to Alexa Fluor 488 (Bioss Antibodies, catalog number bs-0260R-A488). The antibody labels cells that express the Insulin Receptor proportional to the amount of Insulin Receptor expression. $2\times10^5$ cells are incubated with 450 ng of the Insulin Receptor Alpha Antibody conjugated to Alexa Fluor 488 at 4° C. for 30 minutes in the dark, after being blocked by human serum from AB plasma (Sigma-Aldrich) for 10 minutes. After being washed two times with PBS, cells are analyzed on a LSR II (BD Biosciences, San Jose, CA.) machine running the FACSDiva™ software (BD Biosciences, San Jose, CA.). tdTomato+ HEK293 cells that were incubated with the negative control fusogen are used to set up the negative gate for the Insulin Receptor Alpha Antibody conjugated to Alexa Fluor 488 signal. The gate is chosen such that the percent of positive events for Insulin Receptor Alpha Antibody conjugated to Alexa Fluor 488 is equal to 0.0% The percent of events that are positive for the Insulin Receptor Alpha Antibody conjugated to Alexa Fluor 488 is measured in sorted cells that were treated with fusosomes derived from cells expressing the Insulin Receptor.

In some embodiments, the percent of sorted cells with surface Insulin Receptor expression is higher in cells treated with fusosomes derived from cells expressing the Insulin Receptor as compared to the negative control fusosomes derived from cells expressing mTagBFP2.

Example 116: Fusosomes Deliver a Heterologous, Signal Peptide-Targeted Transmembrane Protein to Recipient Cells This example describes fusosome fusion with a cell in vitro. In some embodiments, fusosome fusion with a recipient cell results in the delivery of a heterologous membrane protein payload to the recipient cell's plasma membrane.

A fusosome composition, resulting from cell-derived vesicles or cell-derived cytobiologics as produced by any one of the methods described in previous Examples, except the fusosome is engineered such that the fusogen is in-frame with the open reading frame of Cre and with the open reading frame of a membrane-targeted GFP, separated by a P2A and T2A self-cleaving peptide sequence respectively. The membrane-targeted GFP is generated by fusing the N terminus of the coding sequence of GFP to the first twenty-six amino acids of LCK, a Src family tyrosine kinase containing two palmitoylation domains and a single myristoylation domain. A negative control fusosome is engineered such that the fusogen is in-frame with the open reading frame of Cre and with the open reading frame of cytosolic GFP (the coding sequence of GFP without any additional targeting peptide sequences), each separated by a P2A self-cleaving peptide sequence. See, for example, Chen X, et al., Genes Dis. 2015 March; 2(1):96 105.DOI:10.1016/j.gendis.2014.12.001, and Benediktsson A, et al, Journal of Neuroscience Methods 2005 141, 41-53.

A sufficient number of fusosomes are then incubated at 37° C. and 5% $CO_2$ together with recipient HEK293 cells that have a loxP-STOP-loxP-tdTomato reporter for a period of 48 h in complete media (DMEM+10% FBS+Pen/Strep). Fusosome fusion with the HEK293 cells that have a loxP-STOP-loxP-tdTomato reporter results in tdTomato expression due to Cre recombinase excising from DNA the stop codon that blocks tdTomato expression. Following the 48 hr incubation, the tdTomato positive cells are then isolated via FACS, using a FACS cytometer (Becton Dickinson, San Jose, CA, USA) with 561 nm laser excitation and emission is collected at 590+/−20 nm.

Membrane localization of GFP in the plasma membrane of the sorted HEK293 cells is assayed via confocal microscopy. Prior to confoncal microscopy sorted HEK293 cells are stained with a reagent that labels the plasma membrane (e.g. CellMask Deep Red Plasma Membrane Stain, Invitrogen, Catalog number C10046). Imaging experiments are performed with a Zeiss LSM 710 inverted microscope using a Plan Apochromat 63×1.4 numerical aperture oil objective. A 488 nm argon laser is used to excite GFP/EGFP and a 632 nm Helium-Neon laser is used to excite the plasma membrane stain. A MATLAB script is written to determine the average GFP intensity of the plasma membrane and cytosol for each cell. In the script the average intensity in the plasma membrane (defined by 6 pixels on either side of the plasma membrane as defined by the plasma membrane stain) and the cytosol (region within the plasma membrane region) are calculated. The values for plasma membrane and cytosol intensity for each cell are then used to calculate the % plasma membrane localization. The % plasma membrane localization is calculated with the following equation: plasma membrane intensity over the total (plasma membrane+cytosol) intensity×100%. See, for example, Johnson A, et al., Scientific Reports 6: 19125 (2015).

In some embodiments, the sorted cells treated with fusosomes containing plasma-membrane localized GFP have higher % plasma membrane localization of GFP than the sorted cells treated with fusosomes containing cytosolic GFP.

Example 117: Fusosome Delivery of a Nuclear-Targeted Protein

This example describes fusosome fusion with a cell in vitro. In an embodiment, fusosome fusion with a cell in vitro results in delivery of a protein to the recipient cell nucleus.

A fusosome composition, resulting from cell-derived vesicles or cell-derived cytobiologics as produced by any one of the methods described in previous Examples, contains mRNA encoding LRH-1 (e.g., as described in Mamrosh et al., *eLife* 3: e01694, 2014). As a negative control, a fusosome composition contains mRNA with a missense mutation that prevents translation of LRH-1.

A sufficient number of fusosomes are then incubated at 37° C. and 5% $CO_2$ together with a recipient HEK293 cell line for a period of 12 hours in in DMEM containing 20% Fetal Bovine Serum and 1× Penicillin/Streptomycin.

Following the 12 hr incubation, the cells are prepared for imaging. The cells are fixed, permeabilized, blocked, and immunostained with an anti-LRH-1 antibody conjugated FITC (for example, LSBio catalog number LC-C423401-100). Following immunostaining, the cells are counterstained with DAPI to label the nucleus.

In this example cells are imaged on a Zeiss LSM 710 confocal microscope with a 63× oil immersion objective while maintained at 37C and 5% $CO_2$. DAPI is subjected to 405 nm laser excitation and FITC is subjected to 488 nm laser excitation.

A MATLAB script is written to determine the average FITC intensity of the nucleus in the field of view. In the script the average intensity in the nucleus (defined by 6 pixels on either side of the nucleus as defined by the DAPI stain). Any FITC signal outside of the nucleus is defined as non-nuclear. The values for nuclear and non-nuclear intensity in each field of view are then used to calculate the % nuclear localization. The % nuclear localization is calculated with the following equation: nuclear localization intensity over the total (nuclear+non-nuclear) intensity×100%.

In some embodiments, the cells treated with fusosomes containing LRH-1 mRNA will have a higher % nuclear localization of FITC signal than the cells treated with fusosomes containing missense LRH-1 mRNA. This assay can be used to show fusosomes delivering therapeutic proteins to the nucleus of recipient cells.

Example 118: Delivery of GFP that does not Naturally go to the Nucleus, but Targets the Nucleus Upon Addition of a Nuclear Localization Sequence This example describes fusosome fusion with a cell in vitro. In an embodiment, fusosome fusion with a cell in vitro results in delivery of a protein to the recipient cell nucleus.

A fusosome composition, resulting from cell-derived vesicles or cell-derived cytobiologics as produced by any one of the methods described in previous Examples, contains mRNA encoding a translational fusion between EGFP and a nuclear localization sequence (e.g. one of the nuclear localization sequences in Table 6-1). As a negative control, a fusosome composition contains mRNA encoding EGFP without a nuclear localization sequence.

A sufficient number of fusosomes are then incubated at 37° C. and 5% $CO_2$ together with a recipient HEK293 cell line for a period of 12 hours in in DMEM containing 20% Fetal Bovine Serum and 1× Penicillin/Streptomycin.

Following the 12 hr incubation, the cells are imaged. Prior to imaging the cells are stained with 1 μg/mL Hoechst 33342 to label the nucleus and with a stain that labels the plasma membrane (e.g. CellMask Deep Red Plasma Membrane Stain, Invitrogen, Catalog number C10046). In this example cells are imaged on a Zeiss LSM 710 confocal microscope with a 63× oil immersion objective while maintained at 37 C and 5% $CO_2$. Hoechst is subjected to 405 nm laser excitation, EGFP is subjected to 488 nm laser excitation, and the plasma membrane stain is subjected to 632 nm Helium-Neon laser excitation.

A MATLAB script is written to determine the average EGFP intensity of the nucleus and cytosol for each cell. In the script the average intensity in the nucleus (defined by 6 pixels on either side of the nucleus as defined by the Hoechst 33342 stain) and the cytosol (region within the plasma membrane region and outside of the nucleus) are calculated. The values for nucleus and cytosol intensity for each cell are then used to calculate the % nuclear localization. The % nuclear localization is calculated with the following equation: nuclear localization intensity over the total (nuclear+cytosol) intensity×100%.

In some embodiments, the cells treated with fusosomes containing EGFP-NLS fusion protein will have higher % nuclear localization of EGFP than the cells treated with fusosomes containing EGFP. This assay can be used to show fusosomes delivering proteins to the nucleus of recipient cells.

Example 119: Delivery of a Nanobody Containing a Nuclear Localization Sequence that Drives Localization of an Endogenous Cytosolic Protein to the Nucleus in a Recipient Cell This example describes fusosome fusion with a cell in vitro. In an embodiment, fusosome fusion with a cell in vitro results in delivery of nanobody containing a nuclear localization sequence that subsequently drives an endogenous cytosolic protein to the nucleus in the recipient cell.

A fusosome composition, resulting from cell-derived vesicles or cell-derived cytobiologics as produced by any one of the methods described in previous Examples, contains a DNA plasmid encoding a nanobody that recognizes GFP protein, and the nanobody also contains a nuclear localization sequence (e.g. one of the nuclear localization sequences in Table 6-1). As a negative control, a fusosome composition contains the same GFP-targeted nanobody but lacking the nuclear localization sequence.

A sufficient number of fusosomes are then incubated at 37° C. and 5% CO2 together with a recipient HEK293 cell line endogenously expressing GFP for a period of 24 hours in in DMEM containing 10% Fetal Bovine Serum and 1× Penicillin/Streptomycin.

Following the 24 hr incubation, the cells are imaged. Prior to imaging the cells are stained with 1 μg/mL Hoechst 33342 to label the nucleus and with a stain that labels the plasma membrane (e.g. CellMask Deep Red Plasma Membrane Stain, Invitrogen, Catalog number C10046). In this example cells are imaged on a Zeiss LSM 710 confocal microscope with a 63× oil immersion objective while maintained at 37 C and 5% CO2. Hoechst is subjected to 405 nm laser excitation, GFP is subjected to 488 nm laser excitation, and the plasma membrane stain is subjected to 632 nm Helium-Neon laser excitation.

An ImageJ macro is written to determine the average EGFP intensity of the nucleus and cytosol for each cell. In the macro the average intensity in the nucleus (defined by 6 pixels on either side of the nucleus as defined by the Hoechst 33342 stain after thresholding and subtracting background appropriately) and the cytosol (region within the plasma membrane region and outside of the nucleus) are calculated. The values for nucleus and cytosol integrated pixel intensity for each cell are then used to calculate the % nuclear localization. The % nuclear localization is calculated with the following equation: nuclear localization integrated intensity over the total (nuclear+cytosol) intensity×100%.

In some embodiments, the cells treated with fusosomes containing the GFP-targeted nanobody with nuclear localization sequence will have higher % nuclear localization of GFP than the cells treated with fusosomes containing GFP-targeted nanobody without the nuclear localization sequence. This assay can be used to show fusosomes delivering a targeted nanobody that can drive endogenous protein localization to the nucleus of recipient cells.

Example 120: Delivery of DNA in the Presence of Absence of a Nuclear-Targeting Protein This example describes fusosome fusion with a cell in vitro. In an embodiment, fusosome fusion with a cell in vitro results in delivery of DNA to the nucleus of the cell.

A fusosome composition, resulting from cell-derived vesicles or cell-derived cytobiologics as produced by any one of the methods described in previous Examples, contains a DNA plasmid containing a tetracycline repressor (TetR) binding site and a DNA-probe binding site along with TetR-NLS, which is a TetR protein translationally fused to a nuclear localization sequence (e.g. one of the nuclear localization sequences in Table 6-1). As a negative control, a fusosome composition contains on the DNA plasmid containing a tetracycline repressor (TetR) binding site and a DNA-probe binding site. In some embodiments, TetR-NLS will bind to the TetR binding site on the plasmid and carry the plasmid along with it into the nucleus as the protein is transported across the nuclear envelope due to its NLS.

A sufficient number of fusosomes are then incubated at 37° C. and 5% CO2 together with a recipient HEK293 cell line for a period of 12 hours in in DMEM containing 20% Fetal Bovine Serum and 1× Penicillin/Streptomycin.

Following the 12 hr incubation, the cells are prepared for fluorescence in situ hybridization (FISH). FISH is conducted using FISH Tag DNA Orange Kit, with Alex Fluor 555 dye (ThermoFisher catalog number F32948). Briefly, a DNA probe that binds to the DNA-probe binding site on the plasmid is generated through a procedure of nick translation, dye labeling, and purification as described in the Kit manual. The cells are then labeled with the DNA probe as described in the Kit manual. Subsequent to labeling with the DNA probe, the cells are stained with 1 μg/mL Hoechst 33342 to label the nucleus.

Next, the cells are imaged on a Zeiss LSM 710 confocal microscope with a 63× oil immersion objective while maintained at 37C and 5% CO2. Hoechst is subjected to 405 nm laser excitation, and the DNA probe is subjected to 555 nm laser excitation to stimulate Alexa Flour.

A MATLAB script is written to measure the localization of the Alex Fluor intensity of the nucleus for each cell. In the script the average intensity in the nucleus is defined by 6 pixels on either side of the nucleus as defined by the Hoechst 33342 stain.

In some embodiments, the cells treated with fusosomes containing the plasmid and TetR-NLS will have higher fluorescence intensity in the nucleus than the cells treated with fusosomes containing the plasmid alone. This assay can be used to show fusosomes delivering a protein that localizes a DNA payload to the nucleus of recipient cells.

Example 121: Delivery of Synthetic Transcription Factor that Upregulates Gene Expression This example describes fusosome fusion with a cell in vitro. In an embodiment, fusosome fusion with a cell in vitro results in delivery of a transcription factor to the recipient cell nucleus.

A fusosome composition, resulting from cell-derived vesicles or cell-derived cytobiologics as produced by any one of the methods described in previous Examples, contains mRNA encoding VP64-p65-Rta translationally fused to the C terminus of a nuclease null *Streptococcus pyogenes* cas9 (VPR-dCas9) and a guide RNA targeting a protospacer. As a negative control, a fusosome composition contains mRNA encoding VPR-dCas9 with a scrambled guide RNA.

VP64-p65-RTA is a translational fusion of three transcriptional activators (VP64, p65, and RTA) that recruit transcriptional machinery to a gene. In this example, the gene that is affected by VP64-p65-RTA is determined by the location of dCas9 binding DNA as directed by a guide RNA, e.g., as described in Chavez et al., Nature Methods 2015 doi: 10.1038/nmeth.3312.

A sufficient number of fusosomes are then incubated at 37° C. and 5% CO2 for a period of 48 hours in in DMEM containing 20% Fetal Bovine Serum and 1× Penicillin/Streptomycin with a recipient HEK293 cell line that has integrated into the genome a protospacer upstream of a mini-CMV promoter and tdTomato. As an additional negative control, the same HEK293 cells are not exposed to any fusosomes.

Following the 48 hr incubation, the cells are imaged. Prior to imaging the cells are stained with 1 μg/mL Hoechst 33342 to label the nucleus. Cells are imaged on a Zeiss LSM 710 confocal microscope with a 63× oil immersion objective while maintained at 37C and 5% CO2. Hoechst is subjected to 405 nm laser excitation, and tdTomato is subject to 561 nm laser excitation. Cells are identified based on the presence of Hoechst and amount of tdTomato fluorescence per cell is measured.

In some embodiments, the cells treated with fusosomes containing VPR-dCas9 and a guide RNA targeting the protospacer will have higher tdTomato fluorescence than cells treated with VPR-dCas9 and a scrambled guide RNA or cells that were not treated with fusosomes. This assay can be used to show fusosomes delivering proteins to the nucleus of recipient cells that alter the transcription level of a target gene.

Example 122: Delivery of Synthetic Epigenetic Factor that Alters Gene Expression This example describes fusosome fusion with a cell in vitro. In an embodiment, fusosome fusion with a cell in vitro results in delivery of a epigenetic modulator to the recipient cell nucleus.

A fusosome composition, resulting from cell-derived vesicles or cell-derived cytobiologics as produced by any one of the methods described in previous Examples, contains mRNA encoding the Tet1 enzymatic domain translationally fused to the C terminus of a nuclease null *Streptococcus pyogenes* cas9 (Tet1-dCas9) and a guide RNA targeting a the Snrpn promoter region. As a negative control, a fusosome composition contains mRNA encoding Tet1-dCas9 with a scrambled guide RNA. Tet1 (ten-eleven translocation) dioxygenases methyl groups on 5-cytosine to form 5-hydroxymethylcytosine, which is then restored to unmodified cytosine. Methylation at 5-cytosine represses adjacent DNA sequence transcription, thus Tet1 activates transcription by removing these methyl groups. In this example, the gene that is affected by Tet1 is determined by the location of dCas9 binding DNA as directed by a guide RNA, e.g., as described in Liu et al., *Cell* 167(1): 233-247, 2016.

A sufficient number of fusosomes are then incubated at 37° C. and 5% CO2 for a period of 72 hours in in DMEM containing 20% Fetal Bovine Serum and 1× Penicillin/Streptomycin with a reporter line. The reporter line is a HEK293 cell line that has integrated into the genome at the Dazl promoter locus a synthetic methylation-sensing promoter (conserved sequence elements from the promoter of an imprinted gene, Snrpn) that controls the expression of GFP (Stelzer et al., *Cell* 163: 218-229, 2015). The Dazl promoter is hypermethylated, and thus the Snrpn promoter is not active and GFP is not expressed in these cells. As an additional negative control, the same HEK293 cells are not exposed to any fusosomes.

Following the 72 hr incubation, mCherry fluorescence is measured with flow cytometry. The cells are run on a FACS cytometer (Becton Dickinson, San Jose, CA, USA) with 561 nm laser excitation and emission collected at 590+/−20 nm. A gate is set up to measure positive tdTomato expression. The gate is chosen such that the HEK293 cells not exposed to any fusosomes are negative for tdTomato expression. The percent of cells that are positive for tdTomato expression is then measured.

In some embodiments, the cells treated with fusosomes containing Tet1-dCas9 and a guide RNA targeting the Snrpn promoter region will have higher tdTomato fluorescence than cells treated with Tet1-dCas9 and a scrambled guide RNA or cells that were not treated with fusosomes. This assay can be used to show fusosomes delivering proteins to the nucleus of recipient cells that alter the epigenetic state of a target gene.

Example 123: Delivery of Protein that is Naturally Targeted to Mitochondria

This example describes fusosome fusion with a cell in vitro. In an embodiment, fusosome fusion with a cell in vitro results in delivery of a protein to the recipient cell mitochondria.

A fusosome composition, resulting from cell-derived vesicles or cell-derived cytobiologics as produced by any one of the methods described in previous Examples, contains mRNA encoding Ornithine Transcarbamylase (OTC). As a negative control, a fusosome composition contains mRNA with a mis sense mutation that prevents translation of OTC.

A sufficient number of fusosomes are then incubated at 37° C. and 5% CO2 together with a recipient HEK293 cell line for a period of 24 hours in in DMEM containing 10% Fetal Bovine Serum and 1× Penicillin/Streptomycin.

Following the 24 hr incubation, the cells are prepared for imaging. The cells are stained with Mitotracker Deep Red FM (Thermofisher catalog number M22426), fixed, permeabilized, blocked, and immunostained with an anti-OTC antibody (for example, abcam catalog number ab91418). Following immunostaining, the cells are counterstained with a secondary antibody conjugated to Alexa Fluor 488 (for example, abcam catalog number ab150077).

In this example cells are imaged on a Zeiss LSM 710 confocal microscope with a 63× oil immersion objective while maintained at 37C and 5% CO2. Mitotracker Deep Red FM is subjected to 632 nm laser excitation and emission captured at 665±20 nm, and Alexa Fluor is subjected to 488 nm laser excitation and emission captured at 510±15 nm.

Colocalization of Alexa Fluor 488 (OTC signal) with Mitotracker Deep Red-labeled mitochondria is calculated by masking mitochondrial regions based on MitoTracker Deep Red fluorescence followed by determining the Alexa Fluor 488 average fluorescence intensity in the mitochondrial region and outside the mitochondrial region. All images are processed in ImageJ (NIH) and mitochondrial regions are thresholded using the Moments threshold algorithm to identify regions after subtracting background.

The average mitochondrial OTC signal is defined as the average fluorescence intensity of Alexa Fluor 488 within the mitochondrial regions and the average non-mitochondrial OTC signal is defined as the average fluorescence intensity of Alexa Fluor 488 outside of the mitochondrial regions (but within the cell boundary dictated by parallel phase contrast images). The normalized mitochondrial OTC signal for a given cell is calculated as the average mitochondrial OTC signal normalized to the non-mitochondrial OTC signal. For each group at least 30-40 cells are imaged and analyzed.

In some embodiments, the cells treated with fusosomes containing OTC mRNA will have a higher average fluorescence intensity of Alexa Fluor 488 within the mitochondrial regions than the cells treated with fusosomes containing missense OTC mRNA. In some embodiments, the cells treated with fusosomes containing OTC mRNA will have a higher normalized mitochondrial OTC signal than the cells treated with fusosomes containing missense OTC mRNA. This assay can be used to show fusosomes delivering therapeutic proteins to the mitochondria of recipient cells.

Example 124: Delivery of Protein that is not Naturally Targeted to the Mitochondria Except Upon Addition of a Mitochondrial Localization Sequence This example describes fusosome fusion with a cell in vitro. In an embodiment, fusosome fusion with a cell in vitro results in delivery of a protein to the recipient cell mitochondria.

A fusosome composition, resulting from cell-derived vesicles or cell-derived cytobiologics as produced by any one of the methods described in previous Examples, contains mRNA encoding a translational fusion between EGFP and a mitochondrial localization sequence (e.g. one of the mitochondrial localization sequences in Table 6-2). As a negative control, a fusosome composition contains mRNA encoding EGFP without a mitochondrial localization sequence.

A sufficient number of fusosomes are then incubated at 37° C. and 5% CO2 together with a recipient HEK293 cell line for a period of 12 hours in in DMEM containing 10% Fetal Bovine Serum and 1× Penicillin/Streptomycin.

Following the 24 hr incubation, the cells are imaged. Prior to imaging the cells are stained with Mitotracker Deep Red FM (Thermofisher catalog number M22426) to label the mitochondria and with a stain that labels the plasma membrane (e.g. CellMask Orange Plasma Membrane Stain, Thermofisher, Catalog number C10045). In this example cells are imaged on a Zeiss LSM 710 confocal microscope with a 63× oil immersion objective while maintained at 37C and 5% CO2. The plasma membrane stain is subjected to 554 nm laser excitation with emission captured at 580±20 nm, Mitotracker Deep Red FM is subjected to 632 nm laser excitation with emission captured at 665±20 nm, and EGFP is subjected to 488 nm laser excitation with emission captured at 510±15 nm.

Colocalization of EGFP with Mitotracker Deep Red-labeled mitochondria is determined by masking mitochondrial regions based on MitoTracker Deep Red fluorescence followed by determining the EGFP average fluorescence intensity in the mitochondrial region and outside the mitochondrial region. All images are processed in ImageJ (NIH) and mitochondrial regions are thresholded using the Moments threshold algorithm to identify regions after subtracting background.

The average mitochondrial EGFP signal is defined as the average fluorescence intensity of EGFP within the mitochondrial regions and the average non-mitochondrial EGFP signal is defined as the average fluorescence intensity of EGFP outside of the mitochondrial regions (but within the cell boundary dictated by the plasma membrane stain). The normalized mitochondrial EGFP signal for a given cell is calculated as the average mitochondrial EGFP signal normalized to the non-mitochondrial EGFP signal. For each group at least 30-40 cells are imaged and analyzed.

In some embodiments, the cells treated with fusosomes containing mitochondrial-targeted EGFP mRNA will have a higher average mitochondrial EGFP signal than the cells treated with fusosomes containing non-mitochondrial-targeted EGFP mRNA. In some embodiments, the cells treated with fusosomes containing mitochondrial-targeted EGFP mRNA will have a higher normalized mitochondrial EGFP signal than the cells treated with fusosomes containing non-mitochondrial-targeted EGFP mRNA. This assay can be used to show fusosomes delivering proteins to the mitochondria of recipient cells.

Example 125: Delivery of Fusosomes Via a Pathway that is Independent of Lysosome Acidification Often, entry of complex biological cargo into target cells is accomplished by endocytosis. Endocytosis requires the cargo to enter an endosome, which matures into an acidified lysosome. Disadvantageously, cargo that enters a cell through endocytosis may become trapped in an endosome or lysosome and be unable to reach the cytoplasm or other desired compartment of the target cell. The cargo may also be damaged by acidic conditions in the lysosome. Some viruses are capable of non-endocytic entry into target cells; however this process is incompletely understood. This example demonstrates that a viral fusogen can be isolated from the rest of the virus and confer non-endocytic entry on a fusosome that lacks other viral proteins.

Fusosomes from HEK-293T cells expressing the Nipah virus receptor-binding G protein and fusion F protein (NivG+F) on the cell surface and expressing Cre recombinase protein were generated according by the standard procedure of ultracentrifugation through a Ficoll gradient to obtain small particle fusosomes, as described herein. To demonstrate delivery of the fusosome to a recipient cell via a non-endocytic pathway, the NivG+F fusosomes were used to treat recipient HEK-293T cells engineered to express a "Loxp-GFP-stop-Loxp-RFP" cassette under CMV promoter. NivF protein is a pH-independent envelope glycoprotein that has been shown to not require environmental acidification for activation and subsequent fusion activity (Tamin, 2002).

The recipient cells were plated 30,000 cells/well into a black, clear-bottom 96-well plate. Four to six hours after plating the recipient cells, the NivG+F fusosomes expressing Cre recombinase protein were applied to the target or non-target recipient cells in DMEM media. The fusosome sample was first measured for total protein content by bicinchoninic acid assay (BCA, ThermoFisher, Cat #23225) according to manufacturer's instructions. Recipient cells were treated with 10 μg of fusosomes and incubated for 24 hrs at 37° C. and 5% CO2. To demonstrate that Cre delivery via NivG+F fusosomes was through a non-endocytic pathway, a parallel wells of recipient cells receiving NivG+F fusosome treatment were co-treated with an inhibitor of endosome/lysosome acidification, bafilomycin A1 (Baf; 100 nM; Sigma, Cat #B1793).

Cell plates were imaged using an automated microscope (www.biotek.com/products/imaging-microscopy-automated-cell-imagers/lionheart-fx-automated-live-cell-imager/). The total cell population in a given well was determined by staining the cells with Hoechst 33342 in DMEM media for 10 minutes. Hoechst 33342 stains cell nuclei by intercalating into DNA and was therefore used to identify individual cells. Hoechst staining was imaged using the 405 nm LED and DAPI filter cube. GFP was imaged using the 465 nm LED and GFP filter cube, while RFP was imaged using the 523 nm LED and RFP filter cube. Images of target and non-target cell wells were acquired by first establishing the LED intensity and integration times on a positive control well containing recipient cells treated with adenovirus coding for Cre recombinase instead of fusosomes.

Acquisition settings were set so that Hoescht, RFP, and GFP intensities were at the maximum pixel intensity values but not saturated. The wells of interest were then imaged using the established settings. Focus was set on each well by autofocusing on the Hoescht channel and then using the established focal plane for the GFP and RFP channels. Analysis of GFP and RFP-positive cells was performed with Gen5 software provided with automated fluorescent microscope (https://www.biotek.com/products/software-robotics-software/gen5-microplate-reader-and-imager-software/).

The images were pre-processed using a rolling ball background subtraction algorithm with a 60 μm width. Cells with GFP intensity significantly above background intensities were thresholded and areas too small or large to be GFP-positive cells were excluded. The same analysis steps were applied to the RFP channel. The number of RFP-positive cells (recipient cells receiving Cre) was then divided by the sum of the GFP-positive cells (recipient cells that did not show delivery) and RFP-positive cells to quantify the percentage RFP conversion, which indicates the amount of fusosome fusion with the recipient cells.

With this assay, the fusosome derived from a HEK-293T cell expressing NivG+F on its surface and containing Cre recombinase protein showed significant delivery via a lysosome-independent pathway, which is consistent with entry via a non-endocytic pathway, as evidenced by a significant delivery of Cre cargo by NivG+F fusosomes even when recipient cells were co-treated with Baf to inhibit endocytosis-mediated uptake (Table 27 below). In this case, the inhibition of cargo delivery by Baf co-treatment was 23.4%.

TABLE 27

RFP conversion in HEK-293T cells

| Group | % RFP conversion (±SD) |
|---|---|
| Recipient + no fusosome | 0.4 ± 0.2% |
| Recipient + NivG + F fusosome | 88.9 ± 3.4% |
| Recipient + NivG + F fusosome + Baf | 68.1 ± 2.7% |

Example 126: Measuring Fusion with a Target Cell

Fusosomes derived from HEK-293T cells expressing the engineered hemagglutinin glycoprotein of measles virus (MvH) and the fusion protein (F) on the cell surface and containing Cre recombinase protein were generated, as described herein. The MvH was engineered so that its natural receptor binding is ablated and target cell specificity is provided through a single-chain antibody (scFv) that recognizes the cell surface antigen, in this case the scFv is designed to target CD8, a co-receptor for the T cell receptor. A control fusosome was used which was derived from HEK-293T cells expressing the fusogen VSV-G on its surface and containing Cre recombinase protein. The target cell was a HEK-293T cell engineered to express a "Loxp-GFP-stop-Loxp-RFP" cassette under CMV promoter, as well as engineered to over-express the co-receptors CD8a and CD8b. The non-target cell was the same HEK-293T cell expressing "Loxp-GFP-stop-Loxp-RFP" cassette but without CD8a/b over-expression. The target or non-target recipient cells were plated 30,000 cells/well into a black, clear-bottom 96-well plate and cultured in DMEM media with 10% fetal bovine serum at 37° C. and 5% CO2. Four to six hours after plating the recipient cells, the fusosomes expressing Cre recombinase protein and MvH+F were applied to the target or non-target recipient cells in DMEM media. Recipient cells were treated with 10 μg of fusosomes and incubated for 24 hours at 37° C. and 5% $CO_2$.

Cell plates were imaged using an automated microscope (www.biotek.com/products/imaging-microscopy-automated-cell-imagers/lionheart-fx-automated-live-cell-imager/). The total cell population in a given well was determined by staining the cells with Hoechst 33342 in DMEM media for 10 minutes. Hoechst 33342 stains cell nuclei by intercalating into DNA and therefore is used to identify individual cells. The Hoechst was imaged using the 405 nm LED and DAPI filter cube. GFP was imaged using the 465 nm LED and GFP filter cube, while RFP was imaged using 523 nm LED and RFP filter cube. Images of target and non-target cell wells were acquired by first establishing the LED intensity and integration times on a positive-control well; i.e., recipient cells treated with adenovirus coding for Cre recombinase instead of fusosomes.

Acquisition settings were set so that Hoescht, RFP, and GFP intensities are at the maximum pixel intensity values but not saturated. The wells of interest were then imaged using the established settings. Focus was set on each well by autofocusing on the Hoescht channel and then using the established focal plane for the GFP and RFP channels. Analysis of GFP and RFP-positive cells was performed with Gen5 software provided with automated fluorescent microscope (https://www.biotek.com/products/software-robotics-software/gen5-microplate-reader-and-imager-software/).

The images were pre-processed using a rolling ball background subtraction algorithm with a 60 μm width. Cells with GFP intensity significantly above background intensities were thresholded and areas too small or large to be GFP-positive cells were excluded. The same analysis steps were applied to the RFP channel. The number of RFP-positive cells (recipient cells receiving Cre) was then divided by the sum of the GFP-positive cells (recipient cells that did not show delivery) and RFP-positive cells to quantify the percent RFP conversion, which describes the amount of fusosome fusion within the target and non-target recipient cell population. For amounts of targeted fusion (fusosome fusion to targeted recipient cells), the percent RFP conversion value is normalized to the percentage of recipient cells that are target recipient cells (i.e., expressing CD8), which was assessed by staining with anti-CD8 antibody conjugated to phycoerythrin (PE) and analyzed by flow cytometry. Finally, the absolute amount of targeted fusion was determined by subtracting the amount of non-target cell fusion from the target cell fusion amount (any value<0 was considered to be 0).

With this assay, the fusosome derived from a HEK-293T cell expressing the engineered MvH(CD8)+F on its surface and containing Cre recombinase protein showed a percentage RFP conversion of 25.2+/−6.4% when the recipient cell was the target HEK-293T cell expressing the "Loxp-GFP-stop-Loxp-RFP" cassette, and 51.1% of these recipient cells were observed to be CD8-positive. From these results, the normalized percentage RFP conversion or amount of targeted fusion was determined to be 49.3+/−12.7% for targeted fusion. The same fusosome showed a percentage RFP conversion of 0.5+/−0.1% when the recipient was the non-target HEK-293T cell expressing "Loxp-GFP-stop-Loxp-RFP" but with no expression of CD8. Based on the above, the absolute amount of targeted fusion for the MvH(CD8)+F fusosome determined to be 48.8% and the absolute amount of targeted fusion for the control VSV-G fusosome was determined to be 0%.

SEQUENCE LISTING (766 sequences)

SEQ ID NO: 1 - protein, 32 aa, Artificial sequence
  HIV-1 gp41 signal sequence
MRVKEKYQHLWRWGWKWGTMLLGILMICSATE

SEQ ID NO: 2 - protein, 4 aa, Artificial sequence
  p21ras signal sequence
CAAL

SEQ ID NO: 3 - protein, 6 aa, Artificial sequence
  p21ras signal sequence
KKKKKK

SEQ ID NO: 4 - protein, 5 aa, Artificial sequence
  p21ras signal sequence
RRRRR

SEQ ID NO: 5 - protein, 21 aa, Artificial sequence
  FGFR4 signal sequence
MRLLLALLGVLLSVPGPPVLS

SEQ ID NO: 6 - protein, 12 aa, Artificial sequence
  ROP7 GTPase signal sequence
CSIMNLMCGSTC

SEQ ID NO: 7 - protein, 45 aa, Artificial sequence
  RGS2 signal sequence
GHKSEEKREKMKRTLLKDWKTRLSYFLQNSSTPGKPKTGKKSKQQ

SEQ ID NO: 8 - protein, 18 aa, Artificial sequence
  LHR signal sequence
RSTLKLTTLQCQYSTVMD

SEQ ID NO: 9 - protein, 18 aa, Artificial sequence
  TSHR signal sequence
RQGLHNMEDVYELIENSH

SEQ ID NO: 10 - protein, 30 aa, Artificial sequence
  TDGF1 signal sequence
MDCRKMARFSYSVIWIMAISKVFELGLVAG

SEQ ID NO: 11 - protein, 16 aa, Artificial sequence
  (GP)IX signal sequence
MPAWGALFLLWATAEA

SEQ ID NO: 12 - protein, 4 aa, Artificial sequence
  VPAC2 signal sequence
RDYR

SEQ ID NO: 13 - protein, 55 aa, Artificial sequence
  Toc159 signal sequence
KMALRVALNNKQSGQITVKTSSSDHLSLAIAGLVPIALSIYQKFKPGVSPSYSIY

SEQ ID NO: 14 - protein, 21 aa, Artificial sequence
  Classical arabinogalactan protein 4 signal sequence
MGSKIVQVFLMLALFATSALA

SEQ ID NO: 15 - protein, 21 aa, Artificial sequence
  Classical arabinogalactan protein 2 signal sequence
MNSKAMQALIFLGFLATSCLA

SEQ ID NO: 16 - protein, 12 aa, Artificial sequence
  L1R signal sequence
MGAAASIQTTVN

SEQ ID NO: 17 - protein, 3 aa, Artificial sequence
  GTP-binding protein Rheb signal sequence
SVM

SEQ ID NO: 18 - protein, 11 aa, Artificial sequence
  CD147 singnal sequence
FALLGTHGASG

SEQ ID NO: 19 - protein, 7 aa, Artificial sequence
  PlcH singnal sequence
RRRTFLK

SEQ ID NO: 20 - protein, 10 aa, Artificial sequence
  Nef signal sequence
MGGKWSKSSV

SEQ ID NO: 21 - protein, 6 aa, Artificial sequence
  Nef signal sequence
DDPERE

SEQ ID NO: 22 - protein, 16 aa, Artificial sequence
  HIV-1 NA7 signal sequence
EEANTGENNSLLHPMS

SEQ ID NO: 23 - protein, 6 aa, Artificial sequence
  DmsA signal sequence
SRRGLV

SEQ ID NO: 24 - protein, 6 aa, Artificial sequence
  TorA/ TorA-MalE signal sequence
SRRRFL

SEQ ID NO: 25 - protein, 6 aa, Artificial sequence
  SufI signal sequence
SRRQFI

SEQ ID NO: 26 - protein, 6 aa, Artificial sequence
  YacK signal sequence
QRRDFL

SEQ ID NO: 27 - protein, 52 aa, Artificial sequence
  Pet (Serine protease pet autotransporter) signal sequence
MNKIYSIKYSAATGGLIAVSELAKKVICKTNRKISAALLSLAVISYTNIIYA

SEQ ID NO: 28 - protein, 40 aa, Artificial sequence
  Influenza A Neuraminidase signal sequence
MNPNQKIITIGSICMVIGIVSLMLQIGNIISIWVSHSIQT

SEQ ID NO: 29 - protein, 16 aa, Artificial sequence
  prRDH signal sequence
LRCLACSCFRTPVWPR

SEQ ID NO: 30 - protein, 10 aa, Artificial sequence
  Lck signal sequence
MGCGCSSHPE

SEQ ID NO: 31 - protein, 9 aa, Artificial sequence
  BoNT/ A-LC signal sequence
MPFVNKQFN

SEQ ID NO: 32 - protein, 28 aa, Artificial sequence
  Yck2p signal sequence
DEQNAKNAAQDRNSNKSSKGFFSKLGCC

SEQ ID NO: 33 - protein, 10 aa, Artificial sequence
  GAP-43 signal sequence
MLCCMRRTKQ

SEQ ID NO: 34 - protein, 14 aa, Artificial sequence
  FSHR signal sequence
VTNGSTYILVPLSH

SEQ ID NO: 35 - protein, 7 aa, Artificial sequence
  M3 mAChR signal sequence
AETENFV

SEQ ID NO: 36 - protein, 18 aa, Artificial sequence
  pIgR signal sequence
RARHRRNVDRVSIGSYRT

SEQ ID NO: 37 - protein, 4 aa, Artificial sequence
  RhBG signal sequence
YEDQ

SEQ ID NO: 38 - protein, 19 aa, Artificial sequence
  GM-CSF Receptor (GM_CSFR) signal sequence
LLVTSLLLCELPHPAFLIP

SEQ ID NO: 39 - protein, 10 aa, Artificial sequence
  Prdx6 signal sequence
DSWGILFSHP

SEQ ID NO: 40 - protein, 8 aa, Artificial sequence
  OCA2/ GLUT8/ p40/ ZIP1 signal sequence
  MOD_RES (3)..(3): Any amino acid
  MOD_RES (4)..(4): Any amino acid
  MOD_RES (5)..(5): Any amino acid
DEXXXLLI

SEQ ID NO: 41 - protein, 6 aa, Artificial sequence
  GLUT8 signal sequence
  MOD_RES (2)..(2): Any amino acid
  MOD_RES (3)..(3): Any amino acid
  MOD_RES (4)..(4): Any amino acid
EXXXLL

SEQ ID NO: 42 - protein, 13 aa, Artificial sequence
  CLN3 signal sequence
  MOD_RES (4)..(4): Any amino acid
  MOD_RES (5)..(5): Any amino acid
  MOD_RES (6)..(6): Any amino acid
  MOD_RES (7)..(7): Any amino acid
  MOD_RES (8)..(8): Any amino acid
  MOD_RES (9)..(9): Any amino acid
  MOD_RES (10)..(10): Any amino acid
  MOD_RES (11)..(11): Any amino acid
EEEXXXXXXXXLI

SEQ ID NO: 43 - protein, 4 aa, Artificial sequence
  HLA-DM/ CD8 signal sequence
YTPL

SEQ ID NO: 44 - protein, 6 aa, Artificial sequence
  gp-75 signal sequence
NQPLLT

SEQ ID NO: 45 - protein, 34 aa, Artificial sequence
  FasL signal sequence
RRPGQRRPPPPPPPPPLPPPPPPPPLPPLPLPPL

SEQ ID NO: 46 - protein, 20 aa, Artificial sequence
  Limp II signal sequence
RGQGSMDEGTADERAPLIRT

SEQ ID NO: 47 - protein, 10 aa, Artificial sequence
  LAMP1/ Ptc1/ Endocytosed GalR1/ CLN7/ tyrosinase/ SPPL2a signal sequence
  MOD_RES (2)..(2): Any amino acid
  MOD_RES (3)..(3): Any amino acid
YXXVIFLWCM

SEQ ID NO: 48 - protein, 6 aa, Artificial sequence
  Insulin receptor signal sequence
EKITLL

SEQ ID NO: 49 - protein, 9 aa, Artificial sequence
  CXCR4 signal sequence
SSLKILSKG

SEQ ID NO: 50 - protein, 23 aa, Artificial sequence
  EGF receptor signal sequence
PNQALLRILKETEFKKIKVLGSG

SEQ ID NO: 51 - protein, 5 aa, Artificial sequence
  Nramp2 signal sequence
YLLNT

SEQ ID NO: 52 - protein, 4 aa, Artificial sequence
  Nramp1 (Slc11a1) signal sequence
YGSI

SEQ ID NO: 53 - protein, 5 aa, Artificial sequence
  Cystinosin signal sequence
GYDQL

SEQ ID NO: 54 - protein, 5 aa, Artificial sequence
  Cystinosin signal sequence
YFPQA

SEQ ID NO: 55 - protein, 7 aa, Artificial sequence
  ClC-3 signal sequence
LLDLLDE

SEQ ID NO: 56 - protein, 22 aa, Artificial sequence
  rab7 signal sequence
LKQETEVELYNEFPEPMKLDKN

SEQ ID NO: 57 - protein, 20 aa, Artificial sequence
  E-cadherin signal sequence
RRRAVVKEPLLPPEDDTRDN

SEQ ID NO: 58 - protein, 6 aa, Artificial sequence
  LAP signal sequence
PGYRHV

SEQ ID NO: 59 - protein, 5 aa, Artificial sequence
  lgp120 signal sequence
  MOD_RES (3)..(4): Any naturally occurring amino acid
GYXXI

SEQ ID NO: 60 - protein, 17 aa, Artificial sequence
  prosaposin signal sequence
GTEKCVWGPSYWCQNME

SEQ ID NO: 61 - protein, 5 aa, Artificial sequence
  ARD1 signal sequence
  MOD_RES (2)..(2): Any amino acid
  MOD_RES (3)..(3): Any amino acid
  MOD_RES (4)..(4): Any amino acid
KXXXQ

SEQ ID NO: 62 - protein, 6 aa, Artificial sequence
  CLN7 signal sequence
EQEPLL

SEQ ID NO: 63 - protein, 4 aa, Artificial sequence
  LAPTM4 signal sequence
YPAF

SEQ ID NO: 64 - protein, 4 aa, Artificial sequence
  LAPTM4 signal sequence
YEMA

SEQ ID NO: 65 - protein, 11 aa, Artificial sequence
  Cystinosis signal sequence
  MOD_RES (3)..(3): Any amino acid
  MOD_RES (4)..(4): Any amino acid
GYXXVILFWCM

SEQ ID NO: 66 - protein, 10 aa, Artificial sequence
  OA1 signal sequence
SLLKGRQGIY

SEQ ID NO: 67 - protein, 6 aa, Artificial sequence
  Mucolipin-1 signal sequence
ETERLL

SEQ ID NO: 68 - protein, 6 aa, Artificial sequence
  Mucolipin-1 signal sequence
EEHSLL

SEQ ID NO: 69 - protein, 8 aa, Artificial sequence
  mannose 6-phosphate/ insulin-like growth factor II receptor signal sequence
DDSDEDLL

SEQ ID NO: 70 - protein, 6 aa, Artificial sequence
  p40 signal sequence
EQERLL

SEQ ID NO: 71 - protein, 8 aa, Artificial sequence
  RhoB signal sequence
CINCCKVL

SEQ ID NO: 72 - protein, 7 aa, Artificial sequence
  Opi1p signal sequence
  MOD_RES (6)..(6): Any amino acid
EFFDAXE

SEQ ID NO: 73 - protein, 3 aa, Artificial sequence
  VSV-G/ GONST1/ CASP signal sequence
  MOD_RES (2)..(2): Any naturally occurring amino acid
DXE

SEQ ID NO: 74 - protein, 3 aa, Artificial sequence
  FV glycoprotein signal sequence
SKK

SEQ ID NO: 75 - protein, 46 aa, Artificial sequence
  NHE6 signal sequence
MAGARRGWRLAPVRRGVCGPRARPLMRPLWLLFAVSFFGWTGALDG

SEQ ID NO: 76 - protein, 15 aa, Artificial sequence
  E protein (PRRSV) signal sequence
MGSLWSKISQLFVDA

SEQ ID NO: 77 - protein, 28 aa, Artificial sequence
  p-gp160 (HIV-1 envelope protein) signal sequence
MRVKEKYQHLWRWGWRWGTMLLGMLMIC

SEQ ID NO: 78 - protein, 21 aa, Artificial sequence
  FKBP-13 signal sequence
MRLSWFRVLTVLSICLSAVAT

SEQ ID NO: 79 - protein, 29 aa, Artificial sequence
  P450 2C1 signal sequence
MDPVVVLGLCLSCLLLLSLWKQSYGGGKL

SEQ ID NO: 80 - protein, 35 aa, Artificial sequence
  PTP-1B signal sequence
HALSYWKPFLVNMCVATVLTAGAYLCYRFLFNSNT

SEQ ID NO: 81 - protein, 44 aa, Artificial sequence
  hepatitis C virus glycoprotein E1 signal sequence
SPRGSRPSWGPTDPRRRSRNLGKVIDTLTCGFADLMGYIPLVGA

SEQ ID NO: 82 - protein, 24 aa, Artificial sequence
  proinsulin signal sequence
MALWMRFLPLLALLVLWEPKPAQA

SEQ ID NO: 83 - protein, 17 aa, Artificial sequence
  GlcNAc-PI signal sequence
MEAMWLLCVALAVLAWG

SEQ ID NO: 84 - protein, 27 aa, Artificial sequence
  STIM2 signal sequence
IPHDLCHNGEKSKKPSKIKSLFKKKSK

SEQ ID NO: 85 - protein, 69 aa, Artificial sequence
  Ist2 signal sequence
RPSNNNTTTTTTTDATQPHHHHHHHRHRDAGVKNVTNNSKTTESSSSSSAAKEKPKHKKGLLHKLKKKL

SEQ ID NO: 86 - protein, 4 aa, Artificial sequence
  p11/ TASK-1 signal sequence
  MOD_RES (3)..(3): Any amino acid
HKXK

SEQ ID NO: 87 - protein, 40 aa, Artificial sequence
  mTOR signal sequence
VVQAITFIFKSLGLKCVQFLPQVMPTFLNVIRVCDGAIRE

SEQ ID NO: 88 - protein, 21 aa, Artificial sequence
  E3/ 19K (adenovirus) signal sequence
TFCSTALLITALALVCTLLYL

SEQ ID NO: 89 - protein, 18 aa, Artificial sequence
  Cosmc signal sequence
GVMLGSIFCALITMLGHI

SEQ ID NO: 90 - protein, 23 aa, Artificial sequence
  gp36.5/ m164 signal sequence
FLAAFVVMLCITIVTIVVYIYLV

SEQ ID NO: 91 - protein, 29 aa, Artificial sequence
  E1 (HCV) signal sequence
WGVLAGIAYFSMVGNWAKVLVVLLLFAGV

SEQ ID NO: 92 - protein, 10 aa, Artificial sequence
  Tapasin (tpn) signal sequence
TAPASINTPN

SEQ ID NO: 93 - protein, 22 aa, Artificial sequence
  E1 (Rubella virus) signal sequence
WWQLTLGAICALPLAGLLACCA

SEQ ID NO: 94 - protein, 7 aa, Artificial sequence
  B5R envelope protein signal sequence
  MOD_RES (2)..(2): Any amino acid
  MOD_RES (3)..(3): Any amino acid
  MOD_RES (4)..(4): Any amino acid
  MOD_RES (5)..(5): Any amino acid
YXXXXLL

SEQ ID NO: 95 - protein, 5 aa, Artificial sequence
  ABCA signal sequence
  MOD_RES (2)..(2): Any amino acid
  MOD_RES (3)..(3): Any amino acid
LXXKN

SEQ ID NO: 96 - protein, 10 aa, Artificial sequence
  furin signal sequence
CPSDSEEDEG

SEQ ID NO: 97 - protein, 4 aa, Artificial sequence
  furin signal sequence
YKGL

SEQ ID NO: 98 - protein, 34 aa, Artificial sequence
  SCG10 signal sequence
MAKTAMAYKEKMKELSMLSLICSCFYPEPRNINI

SEQ ID NO: 99 - protein, 4 aa, Artificial sequence
  gpI signal sequence
YAGL

SEQ ID NO: 100 - protein, 14 aa, Artificial sequence
  gpI signal sequence
DDFEDSESTDTEEE

SEQ ID NO: 101 - protein, 27 aa, Artificial sequence
  GAD65 signal sequence
MASPGSGFWSFGSEDGSGDSENPGTAR

SEQ ID NO: 102 - protein, 6 aa, Artificial sequence
  rhodopsin signal sequence
QVSAPA

SEQ ID NO: 103 - protein, 30 aa, Artificial sequence
  G1 membrane glycoprotein signal sequence
RLLDSSNATWQRDQPDTHRLSRLDAHVMSM

SEQ ID NO: 104 - protein, 9 aa, Artificial sequence
  SopD2 signal sequence
  MOD_RES (6)..(6): Any amino acid
  MOD_RES (7)..(7): Any amino acid
WEKIMXXFF

SEQ ID NO: 105 - protein, 4 aa, Artificial sequence
  ARD1 (ARF domain) signal sequence
YKNL

SEQ ID NO: 106 - protein, 4 aa, Artificial sequence
  ARD1 (ARF domain) signal sequence
YEGL

SEQ ID NO: 107 - protein, 43 aa, Artificial sequence
  beta-1,4-GT signal sequence
MKFREPLLGGSAAMPGASLQRACRLLVAVCALHLGVTLVYYLA

SEQ ID NO: 108 - protein, 29 aa, Artificial sequence
  miraculin (STI) signal sequence
MKELTMLSLSFFFVSALLAAAANPLLSAA

SEQ ID NO: 109 - protein, 48 aa, Artificial sequence
  IL -15 (LSP) signal sequence
MRISKPHLRSISIQCYLCLLLNSHFLTEAGIHVFILGCFSAGLPKTEA

SEQ ID NO: 110 - protein, 55 aa, Artificial sequence
  EspP (E. coli autotransporter) signal sequence
MNKIYSLKYSHITGGLIAVSELSGRVSSRATGKKKHKRILALCFLGLLQSSYSFA

SEQ ID NO: 111 - protein, 27 aa, Artificial sequence
  ENPP2 signal sequence
MARQGCLGSFQVISLFTFAISVNICLG

SEQ ID NO: 112 - protein, 27 aa, Artificial sequence
  IGFBP3 signal sequence
MQRARPTLWAAALTLLVLLRGPPVARA

SEQ ID NO: 113 - protein, 20 aa, Artificial sequence
  proglucagon signal sequence
MKSVYFVAGLFIMLAQGSWQ

SEQ ID NO: 114 - protein, 29 aa, Artificial sequence
  Levansucrase signal sequence
MNIKKFAKQATVLTFTTALLAGGATQAFA

SEQ ID NO: 115 - protein, 49 aa, Artificial sequence
  XlnC signal sequence
MQQDGTQQDRIKQSPAPLNGMSRRGFLGGAGTLALATASGLLLPGTAHA

SEQ ID NO: 116 - protein, 41 aa, Artificial sequence
  xylanase A signal sequence
MGSYALPRSGVRRSIRVLLLALVVGVLGTATALIAPPGAHA

SEQ ID NO: 117 - protein, 56 aa, Artificial sequence
  EmaA signal sequence
MNKVFKVIWCKTSQTWIAVSELSKAFSLSTTTDIPKKTKIFIAAAPLLFLSFNTNA

SEQ ID NO: 118 - protein, 13 aa, Artificial sequence
  prosomatostatin signal sequence
SDPRLRQFLQKSK

SEQ ID NO: 119 - protein, 13 aa, Artificial sequence
  POMC (pro-opiomelanocortin) signal sequence
CQDLTTESNLLAC

SEQ ID NO: 120 - protein, 16 aa, Artificial sequence
  Prorenin signal sequence
LPTDTTTFKRIFLKRM

SEQ ID NO: 121 - protein, 4 aa, Artificial sequence
  invertase enzyme signal sequence
HDEL

SEQ ID NO: 122 - protein, 4 aa, Artificial sequence
  AGR2 signal sequence
KTEL

SEQ ID NO: 123 - protein, 4 aa, Artificial sequence
  LRP's receptor-associatedprotein(RAP) signal sequence
HNEL

SEQ ID NO: 124 - protein, 4 aa, Artificial sequence
  XP124L signal sequence
KEDL

SEQ ID NO: 125 - protein, 4 aa, Artificial sequence
  ERp59/ PDI/ ABP1 signal sequence
KDEL

SEQ ID NO: 126 - protein, 4 aa, Artificial sequence
  ERp72 signal sequence
KEEL

SEQ ID NO: 127 - protein, 4 aa, Artificial sequence
  ERp61 signal sequence
QEDL

SEQ ID NO: 128 - protein, 5 aa, Artificial sequence
  Yap1 signal sequence
TAKRS

SEQ ID NO: 129 - protein, 8 aa, Artificial sequence
  Yap1 signal sequence
KKKGSKTS

SEQ ID NO: 130 - protein, 10 aa, Artificial sequence
  PLSCR1 signal sequence
GKISKHWTGI

SEQ ID NO: 131 - protein, 49 aa, Artificial sequence
  hnRNP A1 signal sequence
SYNDFGNYNNQSSNFGPMKGGNFGGRSSGPYGGGGQYFAKPRNQGGYGG

SEQ ID NO: 132 - protein, 19 aa, Artificial sequence
  hnRNP A1 signal sequence
SNFGPMKGGNFGGRSSGPY

SEQ ID NO: 133 - protein, 7 aa, Artificial sequence
  NUCKS signal sequence
PPTKKIR

SEQ ID NO: 134 - protein, 16 aa, Artificial sequence
  SA2L (L for longer isoform) signal sequence
KNQKQGKGKTCKKGKK

SEQ ID NO: 135 - protein, 19 aa, Artificial sequence
  SA1/ STAG1 signal sequence
KRKRGRPGRPPSTNKKPRK

SEQ ID NO: 136 - protein, 4 aa, Artificial sequence
  TWIST signal sequence
RKRR

SEQ ID NO: 137 - protein, 5 aa, Artificial sequence
  TWIST signal sequence
KRGKK

SEQ ID NO: 138 - protein, 5 aa, Artificial sequence
  Daxx signal sequence
RKKRR

SEQ ID NO: 139 - protein, 8 aa, Artificial sequence
  Daxx signal sequence
KKSRKEKK

SEQ ID NO: 140 - protein, 27 aa, Artificial sequence
  Hrp1 signal sequence
RSGGNHRRNGRGGRGGYNRRNNGYHPY

SEQ ID NO: 141 - protein, 8 aa, Artificial sequence
  Ty1 Integrase signal sequence
SKKRSLED

SEQ ID NO: 142 - protein, 8 aa, Artificial sequence
  Ty1 Integrase signal sequence
PPRSKKRI

SEQ ID NO: 143 - protein, 10 aa, Artificial sequence
  Ste12 signal sequence
KSAKISKPLH

SEQ ID NO: 144 - protein, 8 aa, Artificial sequence
  Ste12 signal sequence
KNKEISMP

SEQ ID NO: 145 - protein, 16 aa, Artificial sequence
  OCR-2 signal sequence
KKMIEEKKAVLKRKMK

SEQ ID NO: 146 - protein, 19 aa, Artificial sequence
  PI4K230 signal sequence
NFNHIHKRIRRVADKYLSG

SEQ ID NO: 147 - protein, 9 aa, Artificial sequence
  NF-AT signal sequence
CNKRKYSLN

SEQ ID NO: 148 - protein, 5 aa, Artificial sequence
  NF-AT signal sequence
GKRKK

SEQ ID NO: 149 - protein, 3 aa, Artificial sequence
  cytoskeletal red cell protein 4.1R signal sequence
EED

SEQ ID NO: 150 - protein, 6 aa, Artificial sequence
  cytoskeletal red cell protein 4.1R signal sequence
KKKRER

SEQ ID NO: 151 - protein, 6 aa, Artificial sequence
  NF-kB p65 signal sequence
EEKRKR

SEQ ID NO: 152 - protein, 10 aa, Artificial sequence
  Maize R protein signal sequence
GDRRAAPARP

SEQ ID NO: 153 - protein, 13 aa, Artificial sequence
  Maize R protein signal sequence
MISEALRKAIGKR

SEQ ID NO: 154 - protein, 10 aa, Artificial sequence
  Maize R protein signal sequence
MSERKRREKL

SEQ ID NO: 155 - protein, 21 aa, Artificial sequence
  Nab2 signal sequence
  MOD_RES (4)..(4): Any amino acid
  MOD_RES (5)..(5): Any amino acid
  MOD_RES (6)..(6): Any amino acid
  MOD_RES (11)..(11): Any amino acid
  MOD_RES (12)..(12): Any amino acid
  MOD_RES (13)..(13): Any amino acid
  MOD_RES (14)..(14): Any amino acid
  MOD_RES (15)..(15): Any amino acid
  MOD_RES (16)..(16): Any amino acid
GGGXXXKNRRXXXXXXRGGRN

SEQ ID NO: 156 - protein, 25 aa, Artificial sequence
  NIPP1 signal sequence
GNLDIQRPKRKRKNSRVTFSEDDEI

SEQ ID NO: 157 - protein, 31 aa, Artificial sequence
  NIPP1 signal sequence
INPEDVDPSVGRFRNMVQTAVVPVKKKRVEG

SEQ ID NO: 158 - protein, 84 aa, Artificial sequence
  Fli1 signal sequence
GSGQIQLWQFLLELLSDSANASCITWEGTNGEFKMTDPDEVARRWGERKSKPNMNYDKLSRALRYYYDKNIMTKVHGKRYAYKF

SEQ ID NO: 159 - protein, 19 aa, Artificial sequence
  L3 signal sequence
  MOD_RES (10)..(10): Any amino acid
  MOD_RES (11)..(11): Any amino acid
  MOD_RES (12)..(12): Any amino acid
  MOD_RES (13)..(13): Any amino acid
  MOD_RES (14)..(14): Any amino acid
  MOD_RES (15)..(15): Any amino acid
HRKYEAPRHXXXXXXPRKR

SEQ ID NO: 160 - protein, 20 aa, Artificial sequence
  Cyclin H signal sequence
HSAELALNVITKKRKGYEDD

SEQ ID NO: 161 - protein, 23 aa, Artificial sequence
  Cyclin H signal sequence
DYVSKKSKHEEEEWTDDDLVESL

SEQ ID NO: 162 - protein, 5 aa, Artificial sequence
  IGFBP-3 signal sequence
KGRKR

SEQ ID NO: 163 - protein, 12 aa, Artificial sequence
  BET family signal sequence
KGVKRKADTTTP

SEQ ID NO: 164 - protein, 8 aa, Artificial sequence
  cGMP-PK signal sequence
KILKKRHI

SEQ ID NO: 165 - protein, 4 aa, Artificial sequence
  PSR signal sequence
KKIR

SEQ ID NO: 166 - protein, 4 aa, Artificial sequence
  PSR signal sequence
KKYR

SEQ ID NO: 167 - protein, 6 aa, Artificial sequence
  BRD2 signal sequence
KKKKRK

SEQ ID NO: 168 - protein, 18 aa, Artificial sequence
  mSTI1/ Hop signal sequence
KKQALKEKELGNDAYKKK

SEQ ID NO: 169 - protein, 17 aa, Artificial sequence
  Mcm10 signal sequence
KKSTALSRELGKIMRRR

SEQ ID NO: 170 - protein, 16 aa, Artificial sequence
  Mcm10 signal sequence
KKKTVINDLLHYKKEK

SEQ ID NO: 171 - protein, 21 aa, Artificial sequence
  DNAhelicaseQ1 signal sequence
  MOD_RES (3)..(3): Any amino acid
  MOD_RES (4)..(4): Any amino acid
  MOD_RES (5)..(5): Any amino acid
  MOD_RES (6)..(6): Any amino acid
  MOD_RES (7)..(7): Any amino acid
  MOD_RES (8)..(8): Any amino acid
  MOD_RES (9)..(9): Any amino acid
  MOD_RES (10)..(10): Any amino acid
  MOD_RES (11)..(11): Any amino acid
  MOD_RES (12)..(12): Any amino acid
  MOD_RES (13)..(13): Any amino acid
  MOD_RES (14)..(14): Any amino acid
  MOD_RES (15)..(15): Any amino acid
  MOD_RES (16)..(16): Any amino acid
  MOD_RES (17)..(17): Any amino acid
KKXXXXXXXXXXXXXXXKKRK

SEQ ID NO: 172 - protein, 17 aa, Artificial sequence
  5-lipoxygenase signal sequence
KNLEAIVSVIAERNKKK

SEQ ID NO: 173 - protein, 20 aa, Artificial sequence
  hpoly(ADP)poly signal sequence
  MOD_RES (4)..(4): Any amino acid
  MOD_RES (5)..(5): Any amino acid
  MOD_RES (6)..(6): Any amino acid
  MOD_RES (7)..(7): Any amino acid
  MOD_RES (8)..(8): Any amino acid
  MOD_RES (9)..(9): Any amino acid
  MOD_RES (10)..(10): Any amino acid
  MOD_RES (11)..(11): Any amino acid
  MOD_RES (12)..(12): Any amino acid
  MOD_RES (13)..(13): Any amino acid
  MOD_RES (14)..(14): Any amino acid
KRKXXXXXXXXXXXKKKSKK

SEQ ID NO: 174 - protein, 34 aa, Artificial sequence
  HIV-1 associated signal sequence
  MOD_RES (4)..(25): Any naturally occurring amino acid
KRKXXXXXXXXXXXXXXXXXXXXXXKELQKQITK

SEQ ID NO: 175 - protein, 13 aa, Artificial sequence
  dHSF signal sequence
KRQQLKENNKLRR

SEQ ID NO: 176 - protein, 18 aa, Artificial sequence
  Thyroid hormone receptor (TR) signal sequence
KRVAKRKLIEQNRERRRK

SEQ ID NO: 177 - protein, 15 aa, Artificial sequence
  NP of Thogoto virus signal sequence
  MOD_RES (3)..(11): Any amino acid
KRXXXXXXXXXKTKK

SEQ ID NO: 178 - protein, 6 aa, Artificial sequence
  Chicken v-rel signal sequence
KSKKQK

SEQ ID NO: 179 - protein, 7 aa, Artificial sequence
  v-jun signal sequence
KSRKRKL

SEQ ID NO: 180 - protein, 15 aa, Artificial sequence
  RNP B1 signal sequence
KTLETVPLERKKREK

SEQ ID NO: 181 - protein, 8 aa, Artificial sequence
  IL-1a signal sequence
KVLKKRRL

SEQ ID NO: 182 - protein, 24 aa, Artificial sequence
  Ror1 signal sequence
  MOD_RES (2)..(3): Any amino acid
  MOD_RES (5)..(20): Any amino acid
  MOD_RES (22)..(23): Any amino acid
KXXKXXXXXXXXXXXXXXXXKXXK

SEQ ID NO: 183 - protein, 92 aa, Artificial sequence
  cytotoxic ribonuclease signal sequence
  MOD_RES (2)..(31): Any amino acid
  SITE (32)..(34): This region may encompass 1 or 3 residues
  MOD_RES (35)..(89): Any amino acid
  SITE (90)..(92): This region may encompass 1 or 3 residues
LXXXXXXXXXXXXXXXXXXXXXXXXXXXXXXRRRXXXXXXXXXXXXXXXXXXXXXXXXXXXXXXXXXXXXXXXXXXXXXXXXXXXXXXXRRR

SEQ ID NO: 184 - protein, 12 aa, Artificial sequence
  MATa2 signal sequence
NKIPIKDLLNPQ

SEQ ID NO: 185 - protein, 54 aa, Artificial sequence
  TNFRSF10B signal sequence
MEQRGQNAPAASGARKRHGPGPREARGARPGPRVPKTLVLVVAAVLLLVSAESA

SEQ ID NO: 186 - protein, 63 aa, Artificial sequence
  VP1 capsid protein (CVB3) signal sequence
MGTLYARHVNAGSTGPIKSTIRIYFKPKHVKAWIPRPPRLCQYEKAKNVNFQPSGVTTTRQSI

SEQ ID NO: 187 - protein, 22 aa, Artificial sequence
  PsLSD1 signal sequence
CNGCRNMLLYPRGATNVCCALC

SEQ ID NO: 188 - protein, 22 aa, Artificial sequence
  PsLSD1 signal sequence
CANCRTTLMYPYGAPSVKCAVC

SEQ ID NO: 189 - protein, 22 aa, Artificial sequence
  PsLSD1 signal sequence
CGGCRTLLMYTRGATSVRCSCC

SEQ ID NO: 190 - protein, 10 aa, Artificial sequence
  NOL7 signal sequence
MVQLRPRASR

SEQ ID NO: 191 - protein, 16 aa, Artificial sequence
  NOL7 signal sequence
KRFKRRWMVRKMKTKK

SEQ ID NO: 192 - protein, 25 aa, Artificial sequence
  NOL7 signal sequence
RRDKTLLKEKRKRREELFIEQKKRK

SEQ ID NO: 193 - protein, 7 aa, Artificial sequence
  hFGF-1a/ b signal sequence
NYKKPKL

SEQ ID NO: 194 - protein, 8 aa, Artificial sequence
  TR?1 signal sequence
PDGKRKRK

SEQ ID NO: 195 - protein, 11 aa, Artificial sequence
  Cofilin signal sequence
PEEVKKRKKAV

SEQ ID NO: 196 - protein, 9 aa, Artificial sequence
  Basonuclin signal sequence
PKKKSRKSS

SEQ ID NO: 197 - protein, 13 aa, Artificial sequence
  h DNA ligase I signal sequence
PKRRTARKQLPKR

SEQ ID NO: 198 - protein, 7 aa, Artificial sequence
  CDC6 signal sequence
PLKRKKL

SEQ ID NO: 199 - protein, 5 aa, Artificial sequence
  Sam68 signal sequence
  MOD_RES (3)..(4): Any amino acid
PPXXR

SEQ ID NO: 200 - protein, 4 aa, Artificial sequence
  bovine herpesvirus 1 VP22 signal sequence
PRPR

SEQ ID NO: 201 - protein, 10 aa, Artificial sequence
  Mx1 (mouse) signal sequence
REKKKFLKRR

SEQ ID NO: 202 - protein, 14 aa, Artificial sequence
  phosphatase inhibitor 2 (Inh2) signal sequence
REKKRQFEMKRKLH

SEQ ID NO: 203 - protein, 15 aa, Artificial sequence
  PDGF-A signal sequence
RESGKKRKRKRLKPT

SEQ ID NO: 204 - protein, 14 aa, Artificial sequence
  PML signal sequence
RKCSQTQCPRKVIK

SEQ ID NO: 205 - protein, 23 aa, Artificial sequence
  RAC3 signal sequence
RKRKLPCDTPGQGLTCSGEKRRR

SEQ ID NO: 206 - protein, 8 aa, Artificial sequence
  FGF signal sequence
RKRPVRRR

SEQ ID NO: 207 - protein, 26 aa, Artificial sequence
  glucocorticoid receptor signal sequence
  MOD_RES (3)..(12): Any amino acid
  MOD_RES (15)..(24): Any amino acid
RKXXXXXXXXXXRKXXXXXXXXXXKK

SEQ ID NO: 208 - protein, 32 aa, Artificial sequence
  GAL4 signal sequence
  MOD_RES (10)..(28): Any amino acid
RLKKLKCSKXXXXXXXXXXXXXXXXXXXKTKR

SEQ ID NO: 209 - protein, 24 aa, Artificial sequence
  FGF3 signal sequence
RLRRDAGGRGGVYEHLGGAPRRRK

SEQ ID NO: 210 - protein, 18 aa, Artificial sequence
  FGF3 signal sequence
GKGRPRRGFKTRRTQKSS

SEQ ID NO: 211 - protein, 15 aa, Artificial sequence
  BDV-P signal sequence
  MOD_RES (5)..(8): Any amino acid
RRERXXXXRPRKIPR

SEQ ID NO: 212 - protein, 6 aa, Artificial sequence
  SRF signal sequence
RRGLKR

SEQ ID NO: 213 - protein, 6 aa, Artificial sequence
  Dorsal signal sequence
RRKRQR

SEQ ID NO: 214 - protein, 5 aa, Artificial sequence
  TTF-1 signal sequence
RRKRR

SEQ ID NO: 215 - protein, 5 aa, Artificial sequence
  Angiogenin signal sequence
RRRGL

SEQ ID NO: 216 - protein, 4 aa, Artificial sequence
  EBV gp110 signal sequence
RRRR

SEQ ID NO: 217 - protein, 30 aa, Artificial sequence
  cytomegalovirus kinase pUL97  signal sequence
RSRARSASLGTTTQGWDPPPLRRPSRARRR

SEQ ID NO: 218 - protein, 24 aa, Artificial sequence
  cytomegalovirus kinase pUL97 signal sequence
RGGRKRPLRPPLVSLARTPLCRRR

SEQ ID NO: 219 - protein, 19 aa, Artificial sequence
  PDGF-B signal sequence
RVTIRTVRVRRPPKGKHRK

SEQ ID NO: 220 - protein, 8 aa, Artificial sequence
  Cdc6 signal sequence
  MOD_RES (4)..(4): Any naturally occurring amino acid
STPXKRLI

SEQ ID NO: 221 - protein, 57 aa, Artificial sequence
  CrMYC2 signal sequence
SGVVLPSTGVVKSSGGGGGGDSDHSDLEASVVKEAESSRVVDPEKRPRKRGRKPANG

SEQ ID NO: 222 - protein, 36 aa, Artificial sequence
  CrMYC2 signal sequence
DVKIIGREAMIRVQSSKNNHPAARVMGALKDLDLEL

SEQ ID NO: 223 - protein, 55 aa, Artificial sequence
  CrMYC2 signal sequence
GREEPLNHVEAERQRREKLNQRFYALRAVVPNVSKMDKASLLGDAISYINELKAK

SEQ ID NO: 224 - protein, 39 aa, Artificial sequence
  H2RSP signal sequence
SHAAGSKQHESIPGKAKKPKVKKKEKGKKEKGKKKEAPH

SEQ ID NO: 225 - protein, 11 aa, Artificial sequence
  Hepatitis B virus core protein signal sequence
SKLCLGWLWGM

SEQ ID NO: 226 - protein, 6 aa, Artificial sequence
  prothymosin alpha signal sequence
TKKQKT

SEQ ID NO: 227 - protein, 19 aa, Artificial sequence
  Matalpha2 signal sequence
VRILESWFAKNIENPYLDT

SEQ ID NO: 228 - protein, 65 aa, Artificial sequence
  Fli1 signal sequence
VRVNVKREYDHMNGSRESPVDCSVSKCNKLVGGGEANPMNYNSYMDEKNGPPPPNMTTNERRVIV

SEQ ID NO: 229 - protein, 52 aa, Artificial sequence
  LRH1 signal sequence
YHYGLLTCESCKGFFKRTVQNQKRYTCIENQNCQIDKTQRKRCPYCRFKKCI

SEQ ID NO: 230 - protein, 36 aa, Artificial sequence
  LRH1 signal sequence
DVGMKLEAVRADRMRGGRNKFGPMYKRDRALKQQKK

SEQ ID NO: 231 - protein, 30 aa, Artificial sequence
  hnRNP A1 signal sequence
YNDFGNYNNQSSNFGPMKGGNFGGRSSGPY

SEQ ID NO: 232 - protein, 16 aa, Artificial sequence
  Borna Disease Virus p10 signal sequence
LRLTLLELVRRLNGNG

SEQ ID NO: 233 - protein, 35 aa, Artificial sequence
  Pericentrin signal sequence
RRRKVEAGRTKLAHFRQRKTKGDSSHSEKKTAKRK

SEQ ID NO: 234 - protein, 13 aa, Artificial sequence
  EGFR/ ErbB2/ ErbB3/ ErbB4 signal sequence
RRRHIVRKRTLRR

SEQ ID NO: 235 - protein, 14 aa, Artificial sequence
  ErbB2 signal sequence
KRRQQKIRKYTMRR

SEQ ID NO: 236 - protein, 15 aa, Artificial sequence
  NPK1 signal sequence
RRWKEELDEELQRKR

SEQ ID NO: 237 - protein, 7 aa, Artificial sequence
  SMAD1 signal sequence
KKLKKKK

SEQ ID NO: 238 - protein, 18 aa, Artificial sequence
  IL-5 signal sequence
KKYIDGQKKKCGEERRRV

SEQ ID NO: 239 - protein, 5 aa, Artificial sequence
  SRC-3 signal sequence
RKRKL

SEQ ID NO: 240 - protein, 4 aa, Artificial sequence
  SRC-3 signal sequence
KRRR

SEQ ID NO: 241 - protein, 17 aa, Artificial sequence
  p110RB1 signal sequence
KRSAEGGNPPKPLKKLR

SEQ ID NO: 242 - protein, 7 aa, Artificial sequence
  IGFBP-2 signal sequence
PKKLRPP

SEQ ID NO: 243 - protein, 47 aa, Artificial sequence
  IGFBP-5 signal sequence
  MOD_RES (3)..(28): Any amino acid
RRXXXXXXXXXXXXXXXXXXXXXXXXXXRKGFYKRKQCKPSRGRKRG

SEQ ID NO: 244 - protein, 21 aa, Artificial sequence
  Ku70 signal sequence
EGKVTKRKHDNEGSGSKRPKV

SEQ ID NO: 245 - protein, 31 aa, Artificial sequence
  IGFBP-6 signal sequence
  MOD_RES (2)..(12): Any amino acid
RXXXXXXXXXXXHRGFYRKRQCRSSQGQRRG

SEQ ID NO: 246 - protein, 11 aa, Artificial sequence
  UL84 signal sequence
PEKKKEKQEKK

SEQ ID NO: 247 - protein, 11 aa, Artificial sequence
  HIV-1 Tat signal sequence
GRKKRRQRRRA

SEQ ID NO: 248 - protein, 9 aa, Artificial sequence
  FMDV 3D signal sequence
MRKTKLAPT

SEQ ID NO: 249 - protein, 17 aa, Artificial sequence
  RecQ5 signal sequence
SHSSMAKRAKKESQDFI

SEQ ID NO: 250 - protein, 43 aa, Artificial sequence
  CT311 signal sequence
AVEGKPLSRAAQLRERRKDLHVSGKPSPRYALKKRALEAKKNK

SEQ ID NO: 251 - protein, 19 aa, Artificial sequence
  hnRNP D signal sequence
SGYGKVSRRGGHQNSYKPY

SEQ ID NO: 252 - protein, 27 aa, Artificial sequence
  PQBP-1 signal sequence
RDRGYDKADREEGKERRHHRREELAPY

SEQ ID NO: 253 - protein, 33 aa, Artificial sequence
  hnRNP M signal sequence
GEGERPAQNEKRKEKNIKRGGNRFEPYANPTKR

SEQ ID NO: 254 - protein, 27 aa, Artificial sequence
  hnRNP F signal sequence
FKSSQEEVRSYSDPPLKFMSVQRPGPY

SEQ ID NO: 255 - protein, 3 aa, Artificial sequence
  Egr-1 signal sequence
SPS

SEQ ID NO: 256 - protein, 20 aa, Artificial sequence
  Asr1p (recognized by five yeast importins) signal sequence
  MOD_RES (3)..(4): Any amino acid
  MOD_RES (6)..(6): Any amino acid
  MOD_RES (9)..(10): Any amino acid
  MOD_RES (13)..(13): Any amino acid
  MOD_RES (16)..(18): Any amino acid
RKXXLXVYXXVIXKRXXXKR

SEQ ID NO: 257 - protein, 6 aa, Artificial sequence
  Ire1p signal sequence
KKKRKR

SEQ ID NO: 258 - protein, 12 aa, Artificial sequence
  Ire1p signal sequence
KRGSRGGKKGRK

SEQ ID NO: 259 - protein, 4 aa, Artificial sequence
  Ire1p signal sequence
KKGR

SEQ ID NO: 260 - protein, 7 aa, Artificial sequence
  Pin1 signal sequence
KHSQSRR

SEQ ID NO: 261 - protein, 11 aa, Artificial sequence
  Crx signal sequence
KNRRAKCRQQR

SEQ ID NO: 262 - protein, 6 aa, Artificial sequence
  HDGF signal sequence
KPNKRK

SEQ ID NO: 263 - protein, 16 aa, Artificial sequence
  HDGF signal sequence
KRRAGDLLEDSPKRPK

SEQ ID NO: 264 - protein, 4 aa, Artificial sequence
  UL80 Proteins signal sequence
KRRK

SEQ ID NO: 265 - protein, 7 aa, Artificial sequence
  UL80 Proteins signal sequence
RARKRLK

SEQ ID NO: 266 - protein, 6 aa, Artificial sequence
  CMV pAP signal sequence
KRRRER

SEQ ID NO: 267 - protein, 7 aa, Artificial sequence
  CMV pAP signal sequence
KARKRLK

SEQ ID NO: 268 - protein, 36 aa, Artificial sequence
  Opaque2 (O2) signal sequence
MEEAVTMAPAAVSSAVVGDPMEYNAILRRKLEEDLE

SEQ ID NO: 269 - protein, 31 aa, Artificial sequence
  Opaque2 (O2) signal sequence
MPTEERVRKKESNRESARRSRYRKAAHLKEL

SEQ ID NO: 270 - protein, 20 aa, Artificial sequence
  PARP signal sequence
KRKGDEVDGVDEVAKKKSKK

SEQ ID NO: 271 - protein, 11 aa, Artificial sequence
  plant potyviral NIa signal sequence
GKKNQKHKLKM

SEQ ID NO: 272 - protein, 30 aa, Artificial sequence
  plant potyviral NIa signal sequence
KRKGTTRGMGAKSRKFINMYGFDPTDFSYI

SEQ ID NO: 273 - protein, 14 aa, Artificial sequence
  NPR1 signal sequence
KKQRYMEIQETLKK

SEQ ID NO: 274 - protein, 3 aa, Artificial sequence
  AIRE (Autoimmune regulator)/ MSH6 signal sequence
KRK

SEQ ID NO: 275 - protein, 18 aa, Artificial sequence
  HSP70 signal sequence
FKRKHKKDISQNKRAVRR

SEQ ID NO: 276 - protein, 15 aa, Artificial sequence
  VP1 capsid protein (simian virus 40) signal sequence
  MOD_RES (4)..(11): Any amino acid
  MOD_RES (14)..(14): Any amino acid
KRKXXXXXXXXKKXK

SEQ ID NO: 277 - protein, 77 aa, Artificial sequence
  CDTB signal sequence
NVRQLLSGEQGADILMVQEAGSLPSSAVRTSRVIQHGGTPIEEYTWNLGTRSRPNMVYIYYSRLDVGANRVNLAIVS

SEQ ID NO: 278 - protein, 4 aa, Artificial sequence
  MSH6/ BRCA2 signal sequence
KKRR

SEQ ID NO: 279 - protein, 5 aa, Artificial sequence
  MSH6 signal sequence
RKRKR

SEQ ID NO: 280 - protein, 4 aa, Artificial sequence
  hEXO1 signal sequence
KRPR

SEQ ID NO: 281 - protein, 17 aa, Artificial sequence
  TEA/ ATTS protein scalloped signal sequence
RKQVSSHIQVLARRKLR

SEQ ID NO: 282 - protein, 9 aa, Artificial sequence
  BPV-1 E2 signal sequence
KRCFKKGAR

SEQ ID NO: 283 - protein, 14 aa, Artificial sequence
  BPV-1 E2 signal sequence
KCYRFRVKKNHRHR

SEQ ID NO: 284 - protein, 4 aa, Artificial sequence
  HPV type 16 E6 signal sequence
RPRK

SEQ ID NO: 285 - protein, 10 aa, Artificial sequence
  HPV type 16 E7 signal sequence
KQRHLDKKQR

SEQ ID NO: 286 - protein, 8 aa, Artificial sequence
  HPV type 16 E8 signal sequence
KCLKFYSK

SEQ ID NO: 287 - protein, 6 aa, Artificial sequence
  HPV16 L1 signal sequence
KRKKRK

SEQ ID NO: 288 - protein, 17 aa, Artificial sequence
  HPV16 L1 signal sequence
  MOD_RES (4)..(15): Any amino acid
KRKXXXXXXXXXXXXKR

SEQ ID NO: 289 - protein, 11 aa, Artificial sequence
  HPV16 E2 signal sequence
LKCLRYRFKKH

SEQ ID NO: 290 - protein, 8 aa, Artificial sequence
  EBNA-1 signal sequence
KRPRSPSS

SEQ ID NO: 291 - protein, 25 aa, Artificial sequence
  bovine papillomavirus type 1 E1 signal sequence
KRKVLGSSQNSSGSEASETPVKRRK

SEQ ID NO: 292 - protein, 8 aa, Artificial sequence
  U69 protein kinase (HHV-6) signal sequence
PDRKRLRK

SEQ ID NO: 293 - protein, 12 aa, Artificial sequence
  VP19C (HSV-1) signal sequence
PRGSGPRRAAST

SEQ ID NO: 294 - protein, 17 aa, Artificial sequence
  ORF9 (VZV) signal sequence
RRKTTPSYSGQYRTARR

SEQ ID NO: 295 - protein, 28 aa, Artificial sequence
  ICP27 (HSV-1 type 1) signal sequence
ARRPSCSPEQHGGKVARLQPPPTKAQPA

SEQ ID NO: 296 - protein, 15 aa, Artificial sequence
  ICP27 (HSV-1 type 1) signal sequence
RGGRRGRRRGRGRGG

SEQ ID NO: 297 - protein, 9 aa, Artificial sequence
  c-myc signal sequence
PAAKRVKLD

SEQ ID NO: 298 - protein, 10 aa, Artificial sequence
  c-myc signal sequence
RQRRNELKRS

SEQ ID NO: 299 - protein, 37 aa, Artificial sequence
  HPV16 E7 signal sequence
MHGDTPTLHEYMLDLQPETTDLYCYEQLSDSSEEEDE

SEQ ID NO: 300 - protein, 12 aa, Artificial sequence
  HPV16 L2 signal sequence
MRHKRSAKRTKR

SEQ ID NO: 301 - protein, 6 aa, Artificial sequence
  HPV16 L2 signal sequence
RKRRKR

SEQ ID NO: 302 - protein, 20 aa, Artificial sequence
  L2 (human papillomavirus type 6B) signal sequence
IASRRGLVRYSRIGQRGSMH

SEQ ID NO: 303 - protein, 13 aa, Artificial sequence
  repressor alpha 2 signal sequence
MNKIPIKDLLNPQ

SEQ ID NO: 304 - protein, 16 aa, Artificial sequence
  repressor alpha 3 signal sequence
VRILESWFAKNIENPY

SEQ ID NO: 305 - protein, 13 aa, Artificial sequence
  Nuclear myosin I (NM1) signal sequence
GRRKAAKRKWAAQ

SEQ ID NO: 306 - protein, 6 aa, Artificial sequence
  Nk2.2 signal sequence
KKRKRR

SEQ ID NO: 307 - protein, 8 aa, Artificial sequence
  Nk2.2 signal sequence
RYKMKRAR

SEQ ID NO: 308 - protein, 15 aa, Artificial sequence
  5-lipoxygenase (5-LO) signal sequence
RGRKSSGFPKSVKSR

SEQ ID NO: 309 - protein, 11 aa, Artificial sequence
  5-lipoxygenase signal sequence
LRDGRAKLARD

SEQ ID NO: 310 - protein, 8 aa, Artificial sequence
  5-lipoxygenase signal sequence
KCHKDLPR

SEQ ID NO: 311 - protein, 8 aa, Artificial sequence
  IRF2BP2 signal sequence
ARKRKPSP

SEQ ID NO: 312 - protein, 16 aa, Artificial sequence
  CDT signal sequence
REPADLEMNLTVPVRR

SEQ ID NO: 313 - protein, 17 aa, Artificial sequence
  CDT signal sequence
RRTQISSDHFPVGVSRR

SEQ ID NO: 314 - protein, 4 aa, Artificial sequence
  BLM signal sequence
RSKR

SEQ ID NO: 315 - protein, 16 aa, Artificial sequence
  ICP22 signal sequence
RRPALRSPPLGTRKRK

SEQ ID NO: 316 - protein, 14 aa, Artificial sequence
  ICP22 signal sequence
DIPPRPKRARVNLR

SEQ ID NO: 317 - protein, 5 aa, Artificial sequence
  BRCA2 signal sequence
PIKKK

SEQ ID NO: 318 - protein, 8 aa, Artificial sequence
  hPLSCR4 signal sequence
GSIIRKWN

SEQ ID NO: 319 - protein, 31 aa, Artificial sequence
  BPV1 E1 signal sequence
  MOD_RES (4)..(21): Any amino acid
  MOD_RES (26)..(28): Any amino acid
KRKXXXXXXXXXXXXXXXXXXKRRKXXXKRR

SEQ ID NO: 320 - protein, 14 aa, Artificial sequence
  U27 (HHV-7) signal sequence
FDYTPNSKRQRCGM

SEQ ID NO: 321 - protein, 14 aa, Artificial sequence
  act/ inh betaA signal sequence
KKKKKEEEGEGKKK

SEQ ID NO: 322 - protein, 5 aa, Artificial sequence
  adenovE1a signal sequence
KRPRP

SEQ ID NO: 323 - protein, 8 aa, Artificial sequence
  Amida signal sequence
RGRRRRQR

SEQ ID NO: 324 - protein, 5 aa, Artificial sequence
  Amida signal sequence
RKRRR

SEQ ID NO: 325 - protein, 13 aa, Artificial sequence
  BDV-P signal sequence
PPRIYPQLPSAPT

SEQ ID NO: 326 - protein, 8 aa, Artificial sequence
  BDV-P signal sequence
PRPRKIPR

SEQ ID NO: 327 - protein, 42 aa, Artificial sequence
  BIB signal sequence
HSHKKKKIRTSPTFRRPKTLRLRRQPKYPRKSAPRRNKLDHY

SEQ ID NO: 328 - protein, 8 aa, Artificial sequence
  BRCA1 signal sequence
PKKNRLRR

SEQ ID NO: 329 - protein, 6 aa, Artificial sequence
  BRCA1 signal sequence
KRKRRP

SEQ ID NO: 330 - protein, 18 aa, Artificial sequence
  CBP80 signal sequence
  MOD_RES (4)..(14): Any amino acid
RRRXXXXXXXXXXXKRRK

SEQ ID NO: 331 - protein, 9 aa, Artificial sequence
  c-erb-A signal sequence
SKRVAKRKL

SEQ ID NO: 332 - protein, 17 aa, Artificial sequence
  cFOS signal sequence
RRERNKMAAAKCRNRRR

SEQ ID NO: 333 - protein, 17 aa, Artificial sequence
  cJUN signal sequence
KRMRNRIAASKCRKRKL

SEQ ID NO: 334 - protein, 8 aa, Artificial sequence
  c-myb signal sequence
PLLKKIKQ

SEQ ID NO: 335 - protein, 8 aa, Artificial sequence
  VP1 (CPV) signal sequence
PAKRARRG

SEQ ID NO: 336 - protein, 21 aa, Artificial sequence
  CTP signal sequence
KVNSRKRRKEVPGPNGATEED

SEQ ID NO: 337 - protein, 13 aa, Artificial sequence
  DNAseEBV signal sequence
LKDVRKRKLGPGH

SEQ ID NO: 338 - protein, 13 aa, Artificial sequence
  DNAseEBV signal sequence
YKRPCKRSFIRFI

SEQ ID NO: 339 - protein, 9 aa, Artificial sequence
  dyskerin signal sequence
KKEKKKSKK

SEQ ID NO: 340 - protein, 7 aa, Artificial sequence
  H2B signal sequence
GKKRSKA

SEQ ID NO: 341 - protein, 23 aa, Artificial sequence
  ARNT signal sequence
RAIKRRPGLDFDDDGEGNSKFLR

SEQ ID NO: 342 - protein, 17 aa, Artificial sequence
  BLM signal sequence
RKRKKMPASQRSKRRKT

SEQ ID NO: 343 - protein, 24 aa, Artificial sequence
  cytidine deaminase signal sequence
KRPACTLKPECVQQLLVCSQEAKK

SEQ ID NO: 344 - protein, 14 aa, Artificial sequence
  HCV signal sequence
PRGRRQPIPKARQP

SEQ ID NO: 345 - protein, 6 aa, Artificial sequence
  HCV signal sequence
PRRGPR

SEQ ID NO: 346 - protein, 17 aa, Artificial sequence
  DNA pol alpha (human) signal sequence
KKSKKGRQEALERLKKA

SEQ ID NO: 347 - protein, 17 aa, Artificial sequence
  Topo II (human) signal sequence
RKEWLTNFMEDRRQRKL

SEQ ID NO: 348 - protein, 17 aa, Artificial sequence
  Topo II (human) signal sequence
KKQTTLAFKPIKKGKKR

SEQ ID NO: 349 - protein, 17 aa, Artificial sequence
  Glucocorticoid signal sequence
RKCLQAGMNLEARKTKK

SEQ ID NO: 350 - protein, 9 aa, Artificial sequence
  HIV-1 signal sequence
GKKKYKLKH

SEQ ID NO: 351 - protein, 7 aa, Artificial sequence
  HIV1422 signal sequence
KKKYKLK

SEQ ID NO: 352 - protein, 7 aa, Artificial sequence
  HIV1423 signal sequence
KSKKKAQ

SEQ ID NO: 353 - protein, 12 aa, Artificial sequence
  HIV-1Rev signal sequence
RQARRNRRRRWR

SEQ ID NO: 354 - protein, 18 aa, Artificial sequence
  prothymosin alphan signal sequence
KRAAEDDEDDDVDTKKQK

SEQ ID NO: 355 - protein, 7 aa, Artificial sequence
  Huntington disease protein signal sequence
RRKGKEK

SEQ ID NO: 356 - protein, 7 aa, Artificial sequence
  hVDR signal sequence
RRSMKRK

SEQ ID NO: 357 - protein, 19 aa, Artificial sequence
  ICP-8 signal sequence
RKRAFHGDDPFGEGPPDKK

SEQ ID NO: 358 - protein, 42 aa, Artificial sequence
  L25 signal sequence
MAPSAKATAAKKAVVKGTNGKKALKVRTSATFRLPKTLKLAR

SEQ ID NO: 359 - protein, 7 aa, Artificial sequence
  L29 (ribosomal protein) signal sequence
KTRKHRG

SEQ ID NO: 360 - protein, 7 aa, Artificial sequence
  L29 signal sequence
KHRKHPG

SEQ ID NO: 361 - protein, 9 aa, Artificial sequence
  LEF-1 signal sequence
KKKKRKREK

SEQ ID NO: 362 - protein, 38 aa, Artificial sequence
  M9 signal sequence
NQSSNFGPMKGGNFGGRSSGPYGGGGQYFAKPRNQGGY

SEQ ID NO: 363 - protein, 15 aa, Artificial sequence
  M9 signal sequence
YNNQSSNFGPMKGGN

SEQ ID NO: 364 - protein, 13 aa, Artificial sequence
  Mat-alpha signal sequence
MNKIPIKDLLNPG

SEQ ID NO: 365 - protein, 8 aa, Artificial sequence
  Max signal sequence
PQSRKKLR

SEQ ID NO: 366 - protein, 29 aa, Artificial sequence
  Mitosin signal sequence
  MOD_RES (5)..(24): Any amino acid
KRQRXXXXXXXXXXXXXXXXXXXXKKSKK

SEQ ID NO: 367 - protein, 11 aa, Artificial sequence
  MyoD signal sequence
VNEAFETLKRC

SEQ ID NO: 368 - protein, 13 aa, Artificial sequence
  MyoD signal sequence
CKRKTTNADRRKA

SEQ ID NO: 369 - protein, 6 aa, Artificial sequence
  NF-kB signal sequence
QRKRQK

SEQ ID NO: 370 - protein, 17 aa, Artificial sequence
  NF-kB signal sequence
HRIEEKRKRTYETFKSI

SEQ ID NO: 371 - protein, 8 aa, Artificial sequence
  N-myc signal sequence
PPQKKIKS

SEQ ID NO: 372 - protein, 11 aa, Artificial sequence
  NPI-1 signal sequence
  MOD_RES (2)..(2): Any amino acid
  MOD_RES (9)..(10): Any amino acid
SXGTKRSZXXM

SEQ ID NO: 373 - protein, 8 aa, Artificial sequence
  NPI-3 signal sequence
  MOD_RES (5)..(7): Any amino acid
TKRSXXXM

SEQ ID NO: 374 - protein, 9 aa, Artificial sequence
  NS5A signal sequence
PPRKKRTVV

SEQ ID NO: 375 - protein, 18 aa, Artificial sequence
  Nucleolin signal sequence
KRKKEMANKSAPEAKKKK

SEQ ID NO: 376 - protein, 16 aa, Artificial sequence
  Nucleoplasmin signal sequence
  MOD_RES (3)..(12): Any amino acid
KRXXXXXXXXXXKKKL

SEQ ID NO: 377 - protein, 16 aa, Artificial sequence
  Nucloplasmin signal sequence
KRPAATKKAGQAKKKK

SEQ ID NO: 378 - protein, 7 aa, Artificial sequence
  p53-(NLS2) signal sequence
PQPKKKP

SEQ ID NO: 379 - protein, 18 aa, Artificial sequence
  p53-(NLS1) signal sequence
  MOD_RES (3)..(11): Any amino acid
  SITE (3)..(11): This region may encompass 7 or 9 residues, wherein some positions may be absent
KRXXXXXXXXXPQPKKKP

SEQ ID NO: 380 - protein, 7 aa, Artificial sequence
  p54 signal sequence
RIRKKLR

SEQ ID NO: 381 - protein, 7 aa, Artificial sequence
  Pax-QNR signal sequence
LKRKLQR

SEQ ID NO: 382 - protein, 7 aa, Artificial sequence
  PDX-1 signal sequence
RRMKWKK

SEQ ID NO: 383 - protein, 7 aa, Artificial sequence
  Pho4 signal sequence
KVTKNKS

SEQ ID NO: 384 - protein, 8 aa, Artificial sequence
  Pho4 signal sequence
KRRGKPGP

SEQ ID NO: 385 - protein, 10 aa, Artificial sequence
  Pho4p signal sequence
PYLNKRKGKP

SEQ ID NO: 386 - protein, 7 aa, Artificial sequence
  polyoma virus large-T signal sequence
PKKARED

SEQ ID NO: 387 - protein, 7 aa, Artificial sequence
  polyoma virus large-T signal sequence
VSRKRPR

SEQ ID NO: 388 - protein, 11 aa, Artificial sequence
  polyomaVP1 signal sequence
APKRKSGVSKC

SEQ ID NO: 389 - protein, 12 aa, Artificial sequence
  polyomaVP2 signal sequence
EEDGPQKKKRRL

SEQ ID NO: 390 - protein, 12 aa, Artificial sequence
  Hsc3 (proteasomal) signal sequence
TEKKQGKSILYD

SEQ ID NO: 391 - protein, 11 aa, Artificial sequence
  Hsc9 (proteasomal) signal sequence
REKKEKEQKEK

SEQ ID NO: 392 - protein, 11 aa, Artificial sequence
  Hsc iota (proteasomal) signal sequence
LEKKVKKKFDW

SEQ ID NO: 393 - protein, 28 aa, Artificial sequence
  PTHrP signal sequence
YLTQETNKVETYKEQPLKTPGKKKKGKP

SEQ ID NO: 394 - protein, 7 aa, Artificial sequence
  QKI-5 signal sequence
RVHPYQR

SEQ ID NO: 395 - protein, 18 aa, Artificial sequence
  RanBP3 signal sequence
SDREDGNYCPPVKRERTS

SEQ ID NO: 396 - protein, 8 aa, Artificial sequence
  RCP signal sequence
KKKRERLD

SEQ ID NO: 397 - protein, 18 aa, Artificial sequence
  HTLV-1 Rex signal sequence
MPKTRRRPRRSQRKRPPT

SEQ ID NO: 398 - protein, 5 aa, Artificial sequence
  SOX9 signal sequence
PRRRK

SEQ ID NO: 399 - protein, 17 aa, Artificial sequence
  SOX9 signal sequence
KRPMNAFMVWAQAARRK

SEQ ID NO: 400 - protein, 5 aa, Artificial sequence
  SRY signal sequence
RPRRK

SEQ ID NO: 401 - protein, 17 aa, Artificial sequence
  SRY signal sequence
KRPMNAFIVWSRDQRRK

SEQ ID NO: 402 - protein, 8 aa, Artificial sequence
  SV40(VP1) signal sequence
APTKRKGS

SEQ ID NO: 403 - protein, 7 aa, Artificial sequence
  SV40(VP2) signal sequence
PNKKKRK

SEQ ID NO: 404 - protein, 7 aa, Artificial sequence
  SV40 large T antigen signal sequence
PKKKRKV

SEQ ID NO: 405 - protein, 11 aa, Artificial sequence
  alpha (Ta) signal sequence
SDKKVRSRLIE

SEQ ID NO: 406 - protein, 9 aa, Artificial sequence
  TCF-1 signal sequence
KKKRRSREK

SEQ ID NO: 407 - protein, 32 aa, Artificial sequence
  TCPTP signal sequence
RKRIREDRKATTAQKVQQMKQRLNENERKRKR

SEQ ID NO: 408 - protein, 20 aa, Artificial sequence
  TR2 signal sequence
KDCVINKHHRNRCQYCRLQR

SEQ ID NO: 409 - protein, 8 aa, Artificial sequence
  Tst1/ Oct6 signal sequence
GRKRKKRT

SEQ ID NO: 410 - protein, 20 aa, Artificial sequence
  VirD2 (C-terminal) signal sequence
PKRPRDRHDGELGGRKRARG

SEQ ID NO: 411 - protein, 11 aa, Artificial sequence
  VirD2 (N-terminal) signal sequence
EYLSRKGKLEL

SEQ ID NO: 412 - protein, 6 aa, Artificial sequence
  v-Rel signal sequence
KAKRQR

SEQ ID NO: 413 - protein, 10 aa, Artificial sequence
  yeast SKI3 signal sequence
IKYFKKFPKD

SEQ ID NO: 414 - protein, 5 aa, Artificial sequence
  yeast DNApol alpha signal sequence
RKRKK

SEQ ID NO: 415 - protein, 13 aa, Artificial sequence
  vRNPs (influenza A) signal sequence
MASQGTKRSYEQM

SEQ ID NO: 416 - protein, 19 aa, Artificial sequence
  vRNPs (influenza A) signal sequence
KRGINDRNFWRGENGRKTR

SEQ ID NO: 417 - protein, 14 aa, Artificial sequence
  SOCS1 signal sequence
RRMLGAPLRQRRVR

SEQ ID NO: 418 - protein, 13 aa, Artificial sequence
  Lamin L1 signal sequence
VRTTKGKRKRIDV

SEQ ID NO: 419 - protein, 11 aa, Artificial sequence
  Lamin B2 signal sequence
RSSRGKRRRIE

SEQ ID NO: 420 - protein, 15 aa, Artificial sequence
  HSF2 (human) signal sequence
  MOD_RES (4)..(12): Any amino acid
KRKXXXXXXXXXKIR

SEQ ID NO: 421 - protein, 15 aa, Artificial sequence
  HSF2 (human) signal sequence
  MOD_RES (5)..(13): Any amino acid
KRKRXXXXXXXXXKK

SEQ ID NO: 422 - protein, 19 aa, Artificial sequence
  Progesterone receptor signal sequence
  MOD_RES (5)..(14): Any amino acid
RLRKXXXXXXXXXXRKFKK

SEQ ID NO: 423 - protein, 48 aa, Artificial sequence
  Estrogen receptor (human)
RKDRRGGRMLKHKRQRDDGEGRGEVGSAGDMRAANLWPSPLMIKRSKK

SEQ ID NO: 424 - protein, 17 aa, Artificial sequence
  hnRNP K signal sequence
  MOD_RES (3)..(13): Any amino acid
KRXXXXXXXXXXXKRSR

SEQ ID NO: 425 - protein, 28 aa, Artificial sequence
  FHF-1 signal sequence
  MOD_RES (5)..(17): Any amino acid
RQKRXXXXXXXXXXXXXKRRSSPSKDGR

SEQ ID NO: 426 - protein, 17 aa, Artificial sequence
  NO38 signal sequence
  MOD_RES (3)..(13): Any amino acid
KRXXXXXXXXXXXKKTR

SEQ ID NO: 427 - protein, 16 aa, Artificial sequence
  xnf7 signal sequence
  MOD_RES (4)..(11): Any amino acid
KRKXXXXXXXXKKAKV

SEQ ID NO: 428 - protein, 21 aa, Artificial sequence
  N1/ N2 signal sequence
  MOD_RES (6)..(17): Any amino acid
RKKRKXXXXXXXXXXXXKKSK

SEQ ID NO: 429 - protein, 20 aa, Artificial sequence
  SWI5 signal sequence
  MOD_RES (3)..(12): Any amino acid
KKXXXXXXXXXXRKRGRPRK

SEQ ID NO: 430 - protein, 18 aa, Artificial sequence
  TGA-1A signal sequence
  MOD_RES (3)..(13): Any amino acid
KKXXXXXXXXXXXRLRKK

SEQ ID NO: 431 - protein, 21 aa, Artificial sequence
  TGA-1B signal sequence
  MOD_RES (6)..(16): Any amino acid
KKRARXXXXXXXXXXXRQRKK

SEQ ID NO: 432 - protein, 22 aa, Artificial sequence
  VirE2 signal sequence
  MOD_RES (4)..(15): Any amino acid
KLRXXXXXXXXXXXXRREIQKR

SEQ ID NO: 433 - protein, 18 aa, Artificial sequence
  VirE2 signal sequence
  MOD_RES (7)..(13): Any amino acid
RAIKTKXXXXXXXKLKSK

SEQ ID NO: 434 - protein, 17 aa, Artificial sequence
  Androgen receptor signal sequence
  MOD_RES (3)..(12): Any amino acid
RKXXXXXXXXXXRKLKK

SEQ ID NO: 435 - protein, 9 aa, Artificial sequence
  S22 signal sequence
GKRQVLIRP

SEQ ID NO: 436 - protein, 9 aa, Artificial sequence
  S25 signal sequence
GIIKPISKH

SEQ ID NO: 437 - protein, 4 aa, Artificial sequence
  CUL4B signal sequence
KKRK

SEQ ID NO: 438 - protein, 5 aa, Artificial sequence
  Smad3 signal sequence
KKLKK

SEQ ID NO: 439 - protein, 24 aa, Artificial sequence
  DNA polymerase (AcMNPV) signal sequence
DNPGKKRKSTDDNEGPSPKRRVIT

SEQ ID NO: 440 - protein, 10 aa, Artificial sequence
  DNA polymerase (AcMNPV) signal sequence
CSVKRKRDDD

SEQ ID NO: 441 - protein, 31 aa, Artificial sequence
  MSL1 signal sequence
SKPFSCGRSGKGHKRKTPFGNTERKTPVKKL

SEQ ID NO: 442 - protein, 17 aa, Artificial sequence
  USP22 signal sequence
KRELELLKHNPKRRKIT

SEQ ID NO: 443 - protein, 4 aa, Artificial sequence
  Calpain 5 signal sequence
RRRK

SEQ ID NO: 444 - protein, 28 aa, Artificial sequence
  Calpain 5 signal sequence
YIFEVKKPEDEVLICIQQRPKRSTRREG

SEQ ID NO: 445 - protein, 40 aa, Artificial sequence
  Muscovy duck reovirus p10.8 signal sequence
MADAFEVHYIADWADISSEYPKLHILTTSGRVLSVLAELS

SEQ ID NO: 446 - protein, 24 aa, Artificial sequence
  a-1-antitrypsin
MMPSSVSWGILLAGLCCLVPVSLA

SEQ ID NO: 447 - protein, 30 aa, Artificial sequence
  G-CSF signal sequence
MAGPATQSPMKLMALQLLLWHSALWTVQEA

SEQ ID NO: 448 - protein, 46 aa, Artificial sequence
  Factor IX signal sequence
MQRVNMIMAESPSLITICLLGYLLSAECTVFLDHENANKILNRPKR

SEQ ID NO: 449 - protein, 21 aa, Artificial sequence
  Prolactin signal sequence
MKGSLLLLLVSNLLLCQSVAP

SEQ ID NO: 450 - protein, 24 aa, Artificial sequence
  Albumin signal sequence
MKWVTFISLLFLFSSAYSRGVFRR

SEQ ID NO: 451 - protein, 19 aa, Artificial sequence
  HMMSP38 signal sequence
MWWRLWWLLLLLLLLPMWA

SEQ ID NO: 452 - protein, 32 aa, Artificial sequence
  ornithine carbamoyl- transferase signal sequence
MLFNLRILLNNAAFRNGHNFMVRNFRCGQPLQ

SEQ ID NO: 453 - protein, 29 aa, Artificial sequence
  Cytochrome C Oxidase subunit 8A signal sequence
MSVLTPLLLRGLTGSARRLPVPRAKIHSL

SEQ ID NO: 454 - protein, 29 aa, Artificial sequence
  Cytochrome C Oxidase subunit 8A signal sequence
MSVLTPLLLRGLTGSARRLPVPRAKIHSL

SEQ ID NO: 455 - protein, 60 aa, Artificial sequence
  Type III, bacterial signal sequence
MVTKITLSPQNFRIQKQETTLLKEKSTEKNSLAKSILAVKNHFIELRSKLSERFISHKNT

SEQ ID NO: 456 - protein, 23 aa, Artificial sequence
  Viral source signal sequence
MLSFVDTRTLLLLAVTSCLATCQ

SEQ ID NO: 457 - protein, 32 aa, Artificial sequence
  Viral source signal sequence
MGSSQAPRMGSVGGHGLMALLMAGLILPGILA

SEQ ID NO: 458 - protein, 17 aa, Artificial sequence
  Viral source signal sequence
MAGIFYFLFSFLFGICD

SEQ ID NO: 459 - protein, 22 aa, Artificial sequence
  Viral source signal sequence
MENRLLRVFLVWAALTMDGASA

SEQ ID NO: 460 - protein, 27 aa, Artificial sequence
  Viral source signal sequence
MARQGCFGSYQVISLFTFAIGVNLCLG

SEQ ID NO: 461 - protein, 19 aa, Artificial sequence
  Bacillus source signal sequence
MSRLPVLLLLQLLVRPGLQ

SEQ ID NO: 462 - protein, 29 aa, Artificial sequence
  Bacillus source signal sequence
MKQQKRLYARLLTLLFALIFLLPHSSASA

SEQ ID NO: 463 - protein, 22 aa, Artificial sequence
  Secretion signal
MATPLPPPSPRHLRLLRLLLSG

SEQ ID NO: 464 - protein, 18 aa, Artificial sequence
  Secretion signal
MKAPGRLVLIILCSVVFS

SEQ ID NO: 465 - protein, 13 aa, Artificial sequence
  Secretion signal
MLQLWKLLCGVLT

SEQ ID NO: 466 - protein, 13 aa, Artificial sequence
  Secretion signal
MLYLQGWSMPAVA

SEQ ID NO: 467 - protein, 48 aa, Artificial sequence
  Secretion signal
MDNVQPKIKHRPFCFSVKGHVKMLRLDIINSLVTTVFMLIVSVLALIP

SEQ ID NO: 468 - protein, 32 aa, Artificial sequence
  Secretion signal
MPCLDQQLTVHALPCPAQPSSLAFCQVGFLTA

SEQ ID NO: 469 - protein, 46 aa, Artificial sequence
  Secretion signal
MKTLFNPAPAIADLDPQFYTLSDVFCCNESEAEILTGLTVGSAADA

SEQ ID NO: 470 - protein, 19 aa, Artificial sequence
  Secretion signal
MKPLLVVFVFLFLWDPVLA

SEQ ID NO: 471 - protein, 21 aa, Artificial sequence [sequence omitted]

SEQ ID NO: 472 - protein, 70 aa, Artificial sequence
  Secretion signal
MVLTKPLQRNGSMMSFENVKEKSREGGPHAHTPEEELCFVVTHTPQVQTTLNLFFHIFKVLTQPLSLLWG

SEQ ID NO: 473 - protein, 32 aa, Artificial sequence
  Secretion signal
MATPPFRLIRKMFSFKVSRWMGLACFRSLAAS

SEQ ID NO: 474 - protein, 29 aa, Artificial sequence
  Secretion signal
MSFFQLLMKRKELIPLVVFMTVAAGGASS

SEQ ID NO: 475 - protein, 41 aa, Artificial sequence
  Secretion signal
MVSALRGAPLIRVHSSPVSSPSVSGPAALVSCLSSQSSALS

SEQ ID NO: 476 - protein, 20 aa, Artificial sequence
  Secretion signal
MMGSPVSHLLAGFCVWVVLG

SEQ ID NO: 477 - protein, 23 aa, Artificial sequence
  Secretion signal
MASMAAVLTWALALLSAFSATQA

SEQ ID NO: 478 - protein, 45 aa, Artificial sequence
  Secretion signal
MVLMWTSGDAFKTAYFLLKGAPLQFSVCGLLQVLVDLAILGQATA

SEQ ID NO: 479 - protein, 68 aa, Artificial sequence
  Secretion signal
MDFVAGAIGGVCGVAVGYPLDTVKVRIQTEPLYTGIWHCVRDTYHRERVWGFYRGLSLPVCTVSLVSS

SEQ ID NO: 480 - protein, 49 aa, Artificial sequence
  Secretion signal
MEKPLFPLVPLHWFGFGYTALVVSGGIVGYVKTGSVPSLAAGLLFGSLA

SEQ ID NO: 481 - protein, 15 aa, Artificial sequence
  Secretion signal
MGLLLPLALCILVLC

SEQ ID NO: 482 - protein, 26 aa, Artificial sequence
  Secretion signal
MGIQTSPVLLASLGVGLVTLLGLAVG

SEQ ID NO: 483 - protein, 25 aa, Artificial sequence
  Secretion signal
MSDLLLLGLIGGLTLLLLLTLLAFA

SEQ ID NO: 484 - protein, 29 aa, Artificial sequence
  Secretion signal
METVVIVAIGVLATIFLASFAALVLVCRQ

SEQ ID NO: 485 - protein, 35 aa, Artificial sequence
  Secretion signal
MAGSVECTWGWGHCAPSPLLLWTLLLFAAPFGLLG

SEQ ID NO: 486 - protein, 57 aa, Artificial sequence
  Secretion signal
MMPSRTNLATGIPSSKVKYSRLSSTDDGYIDLQFKKTPPKIPYKAIALATVLFLIGA

SEQ ID NO: 487 - protein, 36 aa, Artificial sequence
  Secretion signal
MALPQMCDGSHLASTLRYCMTVSGTVVLVAGTLCFA

SEQ ID NO: 488 - protein, 21 aa, Artificial sequence
  Vrg-6 signal sequence
MKKWFVAAGIGAGLLMLSSAA

SEQ ID NO: 489 - protein, 21 aa, Artificial sequence
  PhoA signal sequence
MKQSTIALALLPLLFTPVTKA

SEQ ID NO: 490 - protein, 21 aa, Artificial sequence
  OmpA signal sequence
MKKTAIAIAVALAGFATVAQA

SEQ ID NO: 491 - protein, 21 aa, Artificial sequence
  STI signal sequence
MKKLMLAIFFSVLSFPSFSQS

SEQ ID NO: 492 - protein, 23 aa, Artificial sequence
  STII signal sequence
MKKNIAFLLASMFVFSIATNAYA

SEQ ID NO: 493 - protein, 32 aa, Artificial sequence
  Amylase signal sequence
MFAKRFKTSLLPLFAGFLLLFHLVLAGPAAAS

SEQ ID NO: 494 - protein, 19 aa, Artificial sequence
  Alpha Factor signal sequence
MRFPSIFTAVLFAASSALA

SEQ ID NO: 495 - protein, 19 aa, Artificial sequence
  Alpha Factor signal sequence
MRFPSIFTTVLFAASSALA

SEQ ID NO: 496 - protein, 19 aa, Artificial sequence
  Alpha Factor signal sequence
MRFPSIFTSVLFAASSALA

SEQ ID NO: 497 - protein, 19 aa, Artificial sequence
  Alpha Factor signal sequence
MRFPSIFTHVLFAASSALA

SEQ ID NO: 498 - protein, 19 aa, Artificial sequence
  Alpha Factor signal sequence
MRFPSIFTIVLFAASSALA

SEQ ID NO: 499 - protein, 19 aa, Artificial sequence
  Alpha Factor signal sequence
MRFPSIFTFVLFAASSALA

SEQ ID NO: 500 - protein, 19 aa, Artificial sequence
  Alpha Factor signal sequence
MRFPSIFTEVLFAASSALA

SEQ ID NO: 501 - protein, 19 aa, Artificial sequence
  Alpha Factor signal sequence
MRFPSIFTGVLFAASSALA

SEQ ID NO: 502 - protein, 21 aa, Artificial sequence
  Endoglucanase V signal sequence
MRSSPLLRSAVVAALPVLALA

SEQ ID NO: 503 - protein, 22 aa, Artificial sequence
  Secretion Signal
MGAAAVRWHLCVLLALGTRGRL

SEQ ID NO: 504 - protein, 17 aa, Artificial sequence
  Fungal source signal sequence
MRSSLVLFFVSAWTALA

SEQ ID NO: 505 - protein, 32 aa, Artificial sequence
  Fibronectin signal sequence
MLRGPGPGRLLLLAVLCLGTSVRCTETGKSKR

SEQ ID NO: 506 - protein, 26 aa, Artificial sequence
  Fibronectin signal sequence
MLRGPGPGLLLLAVQCLGTAVPSTGA

SEQ ID NO: 507 - protein, 31 aa, Artificial sequence
  Fibronectin signal sequence
MRRGALTGLLLVLCLSVVLRAAPSATSKKRR

SEQ ID NO: 508 - protein, 3 aa, Artificial sequence
  PaxG signal sequence
GRV

SEQ ID NO: 509 - protein, 3 aa, Artificial sequence
  CSS1 and Gibberellin regulated family protein signal sequence
SKV

SEQ ID NO: 510 - protein, 3 aa, Artificial sequence
  EDA8/ MEE46 and Aspartyl protease family protein signal sequence
SLM

SEQ ID NO: 511 - protein, 3 aa, Artificial sequence
  Cit1p/ MLYCD signal sequence
SKL

SEQ ID NO: 512 - protein, 3 aa, Artificial sequence
  Hydoxyacid oxidase 1/ catalase (H. polymorpha) signal sequence
SKI

SEQ ID NO: 513 - protein, 3 aa, Artificial sequence
  IPP isomerase(rat) signal sequence
HRM

SEQ ID NO: 514 - protein, 3 aa, Artificial sequence
  PMvK/ PEPCK/ Urate oxidase signal sequence
SRL

SEQ ID NO: 515 - protein, 3 aa, Artificial sequence
  HMG-CoA signal sequence
CKL

SEQ ID NO: 516 - protein, 3 aa, Artificial sequence
  DAS signal sequence
NKL

SEQ ID NO: 517 - protein, 3 aa, Artificial sequence
  MOX signal sequence
ARF

SEQ ID NO: 518 - protein, 3 aa, Artificial sequence
  SCPx/ pre-nsLTP signal sequence
AKL

SEQ ID NO: 519 - protein, 3 aa, Artificial sequence
  AGT (Alanine--glyoxylate aminotransferase) signal sequence
SQL

SEQ ID NO: 520 - protein, 3 aa, Artificial sequence
  AA-CoA thiolase signal sequence
QKL

SEQ ID NO: 521 - protein, 3 aa, Artificial sequence
  Rat liver catalase signal sequence
ANL

SEQ ID NO: 522 - protein, 3 aa, Artificial sequence
  HDE signal sequence
AKI

SEQ ID NO: 523 - protein, 3 aa, Artificial sequence
  gPGK signal sequence
SSL

SEQ ID NO: 524 - protein, 18 aa, Artificial sequence
  PEX2 signal sequence
  MOD_RES (2)..(7): Any amino acid
  MOD_RES (10)..(10): Any amino acid
KXXXXXXILXLFILKLFI

SEQ ID NO: 525 - protein, 20 aa, Artificial sequence
  PMP70 signal sequence
KVFFSRLIQILKIMVPRTFC

SEQ ID NO: 526 - protein, 20 aa, Artificial sequence
  Cit2p signal sequence
MTVPYLNSNRNVASYLQSNS

SEQ ID NO: 527 - protein, 9 aa, Artificial sequence
  HMG-CoA synthase/ MPPD signal sequence
  MOD_RES (3)..(7): Any amino acid
SVXXXXXQL

SEQ ID NO: 528 - protein, 20 aa, Artificial sequence
  FPP signal sequence
MNGDQNSDVYAQEKQDFVQH

SEQ ID NO: 529 - protein, 26 aa, Artificial sequence
  3-ketoacyl-CoA thiolase B signal sequence
MHRLQVVLGHLAGRPESSSALQAAPC

SEQ ID NO: 530 - protein, 15 aa, Artificial sequence
  SPT signal sequence
EALREALQHCPKNKL

SEQ ID NO: 531 - protein, 7 aa, Artificial sequence
  Catalase A signal sequence
LSSNSKF

SEQ ID NO: 532 - protein, 25 aa, Artificial sequence
  Catalase A signal sequence
GFATKFYTEEGNLDWVYNNTPVFFI

SEQ ID NO: 533 - protein, 16 aa, Artificial sequence
  amine oxidase signal sequence
MERLRQIASQATAASA

SEQ ID NO: 534 - protein, 4 aa, Artificial sequence
  human catalase signal sequence
KANL

SEQ ID NO: 535 - protein, 4 aa, Artificial sequence
  cottonseed catalase (Ccat) signal sequence
RPSI

SEQ ID NO: 536 - protein, 4 aa, Artificial sequence
  PpPox1p signal sequence
APKI

SEQ ID NO: 537 - protein, 32 aa, Artificial sequence
  p46Shc/ p66Shc signal sequence
MDLLPPKPKYNPLRNESLSSLEEGASGSTPPE

SEQ ID NO: 538 - protein, 23 aa, Artificial sequence
  GlyRS signal sequence
MSFFNISRRFYSQIVKKSVKIKR

SEQ ID NO: 539 - protein, 47 aa, Artificial sequence
  TgSOD2 signal sequence
MFAAVARRTATGTLPGAVTLFGRKSFEGYYRDYPLHPRNFGVMASLF

SEQ ID NO: 540 - protein, 22 aa, Artificial sequence
  MLYCD signal sequence
LVPRYRGLFHHISKLDGGVRFL

SEQ ID NO: 541 - protein, 34 aa, Artificial sequence
  Top3alpha signal sequence
MIFPVARYALRWLRRPEDRAFSRAAMEMALRGVR

SEQ ID NO: 542 - protein, 46 aa, Artificial sequence
  NUDT9 signal sequence
MAGRLLGKALAAVSLSLALASVTIRSSRCRGIQAFRNSFSSSWFHL

SEQ ID NO: 543 - protein, 23 aa, Artificial sequence
  HCF signal sequence
PNNSGFIYQQHGGQQKRARFDHQ

SEQ ID NO: 544 - protein, 12 aa, Artificial sequence
  70 kD mitochondrial outer membrane protein signal sequence
MKSFITRNKTAI

SEQ ID NO: 545 - protein, 23 aa, Artificial sequence
  SPTm/ glyoxylate aminotransferase 1 (AGT) signal sequence
MFRMLAKASVTLGSRAASWVRNM

SEQ ID NO: 546 - protein, 61 aa, Artificial sequence
  cytochrome c1 signal sequence
MFSNLSKRWAQRTLSKSFYSTATGAASKSGKLTQKLVTAGVAAAGITASTLLYADSLTAEA

SEQ ID NO: 547 - protein, 9 aa, Artificial sequence
  SCS-beta signal sequence
MLSSSFERN

SEQ ID NO: 548 - protein, 63 aa, Artificial sequence
  SIRT3 signal sequence
MAFWGWRAAAALRLWGRVVERVEAGGGVGPFQACGCRLVLGGRDDVSAGLRGSHGARGEPLDP

SEQ ID NO: 549 - protein, 17 aa, Artificial sequence
  PARG signal sequence
MRRMPRCGIRLPLLRPS

SEQ ID NO: 550 - protein, 61 aa, Artificial sequence
  UL12 (herpes virus) or UL12.5 signal sequence
MVDRGLGRHLWRLTRRGPPAAADAVAPRPLMGFYEAATQNQADCQLWALLRRGLTTASTLR

SEQ ID NO: 551 - protein, 42 aa, Artificial sequence
  TFAM signal sequence
MAFLRSMWGVLSALGRSGAELCTGCGSRLRSPFSFVYLPRWF

SEQ ID NO: 552 - protein, 30 aa, Artificial sequence
  APE1 signal sequence
HSLLPALCDSKIRSKALGSDHCPITLYLAL

SEQ ID NO: 553 - protein, 47 aa, Artificial sequence
  VP22 signal sequence
AIRILVCEGSGLLAAANDILAARAQRPAARGSTSGGESRLRGERARP

SEQ ID NO: 554 - protein, 40 aa, Artificial sequence
  GGNNV signal sequence
RGFWANLMQILRDITGVTAICSFLYTKLGIAPFGDPVTMF

SEQ ID NO: 555 - protein, 20 aa, Artificial sequence
  Cdc17 signal sequence
MRTVFSQIPRFKQVNQYIRM

SEQ ID NO: 556 - protein, 11 aa, Artificial sequence
  human 17bHSD10/ SCHAD signal sequence
MAAACRSVKGL

SEQ ID NO: 557 - protein, 46 aa, Artificial sequence
  PBP74 signal sequence
MISASRAAAARLVGTAASRSPAAARPQDGWNGLSHEAFRFVSRRDY

SEQ ID NO: 558 - protein, 10 aa, Artificial sequence
  Omb (Outer mitochondrial membrane cytochrome b5) signal sequence
RHFWADSKSS

SEQ ID NO: 559 - protein, 20 aa, Artificial sequence
  Cit2p signal sequence
MTVPYLNSNRNVASYLQSNS

SEQ ID NO: 560 - protein, 53 aa, Artificial sequence
  hGDH signal sequence
MYRYLAKALLPSRAGPAALGSAANHSAALLGRGRGQPAAASQPGLALAARRHY

SEQ ID NO: 561 - protein, 37 aa, Artificial sequence
  PfHslV signal sequence
MFIRNFVNIIGSQKSITKTIARNYFSDNSKLIIPRHG

SEQ ID NO: 562 - protein, 92 aa, Artificial sequence
  fumarase signal sequence
MLRFTNCSCKTFVKSSYKLNIRRMNSSFRTETDAFGEIHVPADKYWGAQTQRSFQNFKIGGARERMPLPLVHAFGVLKKSAAIVNESLGGLD

SEQ ID NO: 563 - protein, 15 aa, Artificial sequence
  BCS1 signal sequence
RHSTRTQHLSVETSY

SEQ ID NO: 564 - protein, 13 aa, Artificial sequence
  CYP1A1 signal sequence
VVRVTRTWVPKGL

SEQ ID NO: 565 - protein, 30 aa, Artificial sequence
  CYP2E1 signal sequence
MLATRALSLIGKRAISTSVCLRAHGSVVKS

SEQ ID NO: 566 - protein, 13 aa, Artificial sequence
  cytochrome P4502B1 signal sequence
VRGHPKSRGNFPP

SEQ ID NO: 567 - protein, 39 aa, Artificial sequence
  CYP11A1 signal sequence
MLARGLPLRSALVKACPPILSTVGEGWGHHRVGTGEGAG

SEQ ID NO: 568 - protein, 30 aa, Artificial sequence
  GR signal sequence
FSRSFSTPLPLSTKTLISLSPPHRTFAVRA

SEQ ID NO: 569 - protein, 13 aa, Artificial sequence
  P450MT2 signal sequence
TRTWVPKGLKSPP

SEQ ID NO: 570 - protein, 36 aa, Artificial sequence
  Hmi1p signal sequence
VTHGYNVQRYNQLRKNFGFYRAYSSLRGCKSVFRRI

SEQ ID NO: 571 - protein, 30 aa, Artificial sequence
  PR-M (Progesterone Receptor) signal sequence
MEFIYIYMNFFFFFSVGRKFKKFNKVRVVR

SEQ ID NO: 572 - protein, 35 aa, Artificial sequence
  Tom 20 signal sequence
MVGRNSAIAAGVCGALFIGYCIYFDRKRRSDPNFK

SEQ ID NO: 573 - protein, 29 aa, Artificial sequence
  monoamine oxidase B signal sequence
LLRLIGLTTIFSATALGFLAHKRGLLVRV

SEQ ID NO: 574 - protein, 16 aa, Artificial sequence
  3-oxoacyl-CoA thiolase signal sequence
MALLRGVFIVAAKRTP

SEQ ID NO: 575 - protein, 14 aa, Artificial sequence
  bacterial thiolase signal sequence
MSTPSIVIASARTA

SEQ ID NO: 576 - protein, 22 aa, Artificial sequence
  Bcl-2 signal sequence
KTLLSLALVGACITLGAYLGHK

SEQ ID NO: 577 - protein, 29 aa, Artificial sequence
  Tom 70/ Mas70p signal sequence
MKSFITRNKTAILATVAATGTAIGAYYYY

SEQ ID NO: 578 - protein, 12 aa, Artificial sequence
  cytochrome c oxidase subunit IV signal sequence
MLSLRQSIRFFK

SEQ ID NO: 579 - protein, 28 aa, Artificial sequence
  PPOX signal sequence
MGRTVVVLGGGISGLAASYHLSRAPCPP

SEQ ID NO: 580 - protein, 80 aa, Artificial sequence
  cytochrome b2 signal sequence
MLKYKPLLKISKNCEAAILRASKTRLNTIRAYGSTVPKSKSFEQDSRKRTQSWTALRVGAILAATSSVAYLNWHNGQIDN

SEQ ID NO: 581 - protein, 20 aa, Artificial sequence
  KMO signal sequence
CLRRSWNSVTYFQNIGRISL

SEQ ID NO: 582 - protein, 27 aa, Artificial sequence
  F1-ATPase beta-subunit signal sequence
MVLPRLYTATSRAAFKAAKQSAPLLST

SEQ ID NO: 583 - protein, 9 aa, Artificial sequence
  delta-aminolevulinate synthase signal sequence
MQRSIFARF

SEQ ID NO: 584 - protein, 32 aa, Artificial sequence
  OTC signal sequence
MLSNLRILLNKAALRKAHTSMVRNFRYGKPVQ

SEQ ID NO: 585 - protein, 23 aa, Artificial sequence
  GS signal sequence
MATSASSHLSKAIKHMYMKLPQG

SEQ ID NO: 586 - protein, 27 aa, Artificial sequence
  CCHL signal sequence
VAVHNFLNEGAWNEIVEWERRFGKGLM

SEQ ID NO: 587 - protein, 34 aa, Artificial sequence
  CCHL signal sequence
PKDMTPKAALLQVLGRINSKYATEPPFDRHDWYV

SEQ ID NO: 588 - protein, 32 aa, Artificial sequence
  Bcl-x(L) signal sequence
ESRKGQERFNRWFLTGMTVAGVVLLGSLFSRK

SEQ ID NO: 589 - protein, 22 aa, Artificial sequence
  AtSrx signal sequence
MANLMMRLPISLRSFSVSASSS

SEQ ID NO: 590 - protein, 15 aa, Artificial sequence
  MP1 signal sequence
MWRCGGRQGLGVLRR

SEQ ID NO: 591 - protein, 30 aa, Artificial sequence
  CoAsy signal sequence
MAVFRSGLLVLTTPLASLAPRLASILTSAA

SEQ ID NO: 592 - protein, 10 aa, Artificial sequence
  HCV signal sequence
RALAHGVRVL

SEQ ID NO: 593 - protein, 42 aa, Artificial sequence
  Protein A (AHNV) signal sequence
MRSYEFHLARMSGATLCVVTGYRLLTSKWLADRIEDYRQRVI

SEQ ID NO: 594 - protein, 36 aa, Artificial sequence
  Protein A (AHNV) signal sequence
RPTGFWENLKRILRDITGITALCGFLYNKLGMAPFG

SEQ ID NO: 595 - protein, 22 aa, Artificial sequence
  Protein A (FHV) signal sequence
TELLVGIATVSGCGAVVYCISK

SEQ ID NO: 596 - protein, 25 aa, Artificial sequence
  CPT1 signal sequence
RYSLKVLLSYHGWMFAEHGKMSRST

SEQ ID NO: 597 - protein, 29 aa, Artificial sequence
  Cytochrome C Oxidase subunit 8A signal sequence
MSVLTPLLLRGLTGSARRLPVPRAKIHSL

SEQ ID NO: 598 - DNA, 21 bp, Artificial sequence
  Human nDNA (GAPDH) forward primer
ggagtccactggcgtcttcac

SEQ ID NO: 599 - DNA, 24 bp, Artificial sequence
  Human nDNA (GAPDH) reverse primer
gaggcattgctgatgatcttgagg

SEQ ID NO: 600 - DNA, 26 bp, Artificial sequence
  GFP-F
atgagtaaaggagaagaacttttcac

SEQ ID NO: 601 - DNA, 24 bp, Artificial sequence
  GFP-R
gtccttttaccagacaaccattac

SEQ ID NO: 602 - DNA, 26 bp, Artificial sequence
  GFP-F
atgagtaaaggagaagaacttttcac

SEQ ID NO: 603 - DNA, 24 bp, Artificial sequence
  GFP-R
gtccttttaccagacaaccattac

SEQ ID NO: 604 - protein, 5 aa, Artificial sequence
  Caspase 2 protein
VDVAD

SEQ ID NO: 605 - protein, 8 aa, Artificial sequence
  OCA2/ GLUT8/ p40/ ZIP1 motif
DETQPLLI

SEQ ID NO: 606 - protein, 6 aa, Artificial sequence
  GLUT8 motif
ETQPLL

SEQ ID NO: 607 - protein, 13 aa, Artificial sequence
  CLN3 motif
EEEAESAARQPLI

SEQ ID NO: 608 - protein, 5 aa, Artificial sequence
  ARD1 motif
KLMDQ

SEQ ID NO: 609 - protein, 3 aa, Artificial sequence
  VSV-G/ GONST1/ CASP motif
DIE

SEQ ID NO: 610 - protein, 5 aa, Artificial sequence
  ABCA motif
LLWKN

SEQ ID NO: 611 - protein, 9 aa, Artificial sequence
  HIV-1 motif
KRKVEDPYC

SEQ ID NO: 612 - protein, 8 aa, Artificial sequence
  HIV-1 motif
KRKKKPYC

SEQ ID NO: 613 - protein, 24 aa, Artificial sequence
  Ror1 motif
KIYKGHLYLPGMDHAQLVAIKTLK

SEQ ID NO: 614 - protein, 5 aa, Artificial sequence
  Sam68
PPTVR

SEQ ID NO: 615 - protein, 32 aa, Artificial sequence
  GAL4
RLKKLKCSKEKPKCAKCLKNNWECRYSPKTKR

SEQ ID NO: 616 - protein, 47 aa, Artificial sequence
  IGFBP-5 motif
RRHMEASLQELKASPRMVPRAVYLPNCDRKGFYKRKQCKPSRGRKRG

SEQ ID NO: 617 - protein, 31 aa, Artificial sequence
  IGFBP-6
RGAQTLYVPNCDHRGFYRKRQCRSSQGQRRG

SEQ ID NO: 618 - protein, 10 aa, Artificial sequence
  VP1 capsid protein (simian virus 40) motif
MAPKRRRRRK

SEQ ID NO: 619 - protein, 6 aa, Artificial sequence
  HPV16 L1 motif
KRKKRK

SEQ ID NO: 620 - protein, 18 aa, Artificial sequence
  CBP80 motif
RRRHSDENDGGQPHKRRK

SEQ ID NO: 621 - protein, 18 aa, Artificial sequence
  p53-(NLS1) motif
KRALPNNTSSSPQPKKKP

SEQ ID NO: 622 - protein, 15 aa, Artificial sequence
  HSF2 (human) motif
KRKVSSSKPEENKIR

SEQ ID NO: 623 - protein, 16 aa, Artificial sequence
  HSF2 (human) motif
KRKRPLLLNTNGAQKK

SEQ ID NO: 624 - protein, 17 aa, Artificial sequence
  hnRNP K motif
KRPAEDMEEEQAFKRSR

SEQ ID NO: 625 - protein, 28 aa, Artificial sequence
  FHF-1 motif
RQKRQARESNSDRVSASKRRSSPSKDGR

SEQ ID NO: 626 - protein, 16 aa, Artificial sequence
  xnf7 motif
KRKLEEPEPEPKKAKV

SEQ ID NO: 627 - protein, 589 aa, Human orthopneumovirus
  fusion glycoprotein
MIPQARTELNLGQITMELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTGSLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 628 - protein, 553 aa, Avian orthoavulavirus 1
  fusion protein
MDPKPSTSYLHAFPLIFVAISLVFMAGRASALDGRPLAAAGIVVTGDKAVNIYTSSQTGTIIIKLLPNMPKDKEQCAKSPLDAYNRTLTTLLAPLGDSIRRIQESVTTSGGERQERLVGAIIGGVALGVATAAQITAASALIQANQNAANILKLKESIAATNEAVHEVTSGLSQLAVAVGKMQQFVNDQFNKTAQEIDCIKITQQVGVELNLYLTELTTVFGPQITSPALTQLTIQALYNLAGGNMDYMLTKLGVGNNQLSSLISSGLISGNPILYDSQTQLLGIQVTLPSVGNLNNMRATYLETLSVSTNKGFASALVPKVVTQVGSVIEELDTSYCIETDLDLYCTRIVTFPMSPGIFSCLGGNTSACMYSKTEGALTTPYMTLKGSVIANCKMTTCRCADPPGIISQNYGEAVSLIDKKVCNILTLDGITLRLSGEFDATYQKNISIQDSQVVITGNLDISTELGNVNNSISNALDKLEESNSKLDKVNVRLTSTSALITYIVLTTIALICGIVSLVLACYIMYKQKAQQKTLLWLGNNTLDQMRATTKM

SEQ ID NO: 629 - protein, 553 aa, Measles morbillivirus
  fusion protein
MSIMGLKVNVSAIFMAVLLTLQTPTGQIHWGNLSKIGVVGIGSASYKVMTRSSHQSLVIKLMPNITLLNNCTRVEIAEYRRLLRTVLEPIRDALNAMTQNIRPVQSVASSRRHKRFAGVVLAGAALGVATAAQITAGIALHQSMLNSQAIDNLRASLETTNQAIEAIRQAGQEMILAVQGVQDYINNELIPSMNQLSCDLIGQKLGLKLLRYYTEILSLFGPSLRDPISAEISIQALSYALGGDINKVLEKLGYSGGDLLGILESRGIKARITHVDTESYFIVLSIAYPTLSEIKGVIVHRLEGVSYNIGSQEWYTTVPKYVATQGYLISNFDESSCTFMPEGTVCSQNALYPMSPLLQECLRGYTKSCARTLVSGSFGNRFILSQGNLIANCASILCKCYTTGTIINQDPDKILTYIAADNCPVVEVNGVTIQVGSRRYPDAVYLHRIDLGPPILLERLDVGTNLGNAIAKLEDAKELLESSDQILRSMKGLSSTCIVYILIAVCLGGLIGIPALICCCRGRCNKKGEQVGMSRPGLKPDLTGTSKSYVRSL

SEQ ID NO: 630 - protein, 539 aa, Human metapneumovirus
  fusion glycoprotein precursor
MSWKVVIIFSLLITPQHGLKESYLEESCSTITEGYLSVLRTGWYTNVFTLEVGDVENLTCSDGPSLIKTELDLTKSALRELKTVSADQLAREEQIEKPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 631 - protein, 540 aa, Bovine respirovirus 3
  fusion protein
MIIIVITMILSLTPSSLCQIDITKLQSVGVLVNSPKGIKISQNFETRYLILSLIPKIEDSHSCGNQQIDQYKKLLDRLIIPLYDGLKLQKDVIVVNHESHNNTNLRTKRFFGEIIGTIAIGIATSAQITAAVALVEAKQARSDIDKLKEAIKDTNKAVQSIQSSVGNLIVAVKSVQDYVNNEIVPSITRLGCEAAGLQLGIALTQHYSELTNIFGDNIGTLGEKGVKLQGIASLYRTNITEVFTTSTVDQYDIYDLLFTESIKMRVIDVDLSDYSITLQVRLPLLTKVSNTQIYKVDSISYNIQGKEWYIPLPHHIMTKGAFLGGADIKECIESFSNYICPSDPGFILNHEMENCLSGNITQCPKTIVTSDIVPRYAFVDGGVIANCIPTTCTCNGIDNRINQSPDQGIKIITYKECQIVGINGMLFKTNQEGTLAKYTFDNIKLNNSVALNPIDISLELNKAKSDLEESKRWIEKSNQKLDSIGSWHQSSVTIIIIIVMIVVLLIINAIIIMIMIRYLRDRNRHLNNKDSEPYVLTNRQ

SEQ ID NO: 632 - protein, 538 aa, Mumps orthorubulavirus
  fusion protein
MKVFLVTCLGFAVFSSSVCVNINILQQIGYIKQQVRQLSYYSQSSSSYIVVKLLPNIQPTDNSCEFKSVTQYNKTLSNLLLPIAENINNIASPSSGSRRHKRFAGIAIGIAALGVATAAQVTAAVSLVQAQTNARAIAAMKNSIQATNRAVFEVKEGTQRLAIAVQAIQDHINTIMNTQLNNMSCQILDNQLATSLGLYLTELTTVFQPQLINPALSPISIQALRSLLGSMTPAVVQATLSTSISAAEILSAGLMEGQIVSVLLDEMQMIVKINIPTIVTQSNALVIDFYSISSFINNQESIIQLPDRILEIGNEQWSYPAKNCKLTRHHIFCQYNEAERLSLESKLCLAGNISACVFSPIAGSYMRRFVALDGTIVANCRSLTCLCKSPSYPIYQPDHHAVTTIDLTACQTLSLDGLDFSIVSLSNITYAENLTISLSQTINTQPIDISTELSKVNASLQNAVKYIKESNHQLQSVNVNSKIGAIIVAALVLSILSIIISLLFCCWAYVATKEIRRINFKTNHINTISSSVDDLIRY

SEQ ID NO: 633 - protein, 671 aa, Canine morbillivirus
  fusion protein
MNPHEQTIPMHEKIPKRSKTQTHTQQDLPQQHSTKSAESKTSRARHSITSAQRSTHYDPRTADWPDYYIMKRTRSCKQASYRSDNIPAHGDHDGIIHHTPESVSQGAKSRLKMGQSNAVKSGSQCTWLVLWCIGVASLFLCSKAQIHWNNLSTIGIIGTDSVHYKIMTRPSHQYLVIKLMPNVSLIDNCTKAELDEYEKLLSSILEPINQALTLMTKNVKPLQSVGSGRRQRRFAGVVLAGAALGVATAAQITAGIALHQSNLNAQAIQSLRTSLEQSNKAIEEIREATQETVIAVQGVQDYVNNELVPAMQHMSCELVGQRLGLKLLRYYTELLSIFGPSLRDPISAEISIQALSYALGGEIHKILEKLGYSGNDMIAILESRGIKTKITHVDLPGKFIILSVSYPTLSEVKGVIVHRLEAVSYNIGSQEWYTTVPRYVATNGYLISNFDESSCVFVSESAICSQNSLYPMSPLLQQCIRGDTSSCARTLVSGTMGNKFILSKGNIVANCASILCKCYSTSTIINQSPDKLLTFIASDTCPLVEIDGVTIQVGSRQYPDMVYESKVALGPAISLERLDVGTNLGNALKKLDDAKVLIDSSNQILETVRRSSFNFGSLLSVPILSCTALALLLLICCCKRRYQQTHKQNTKVDPTFKPDLTGTSRSYVRSL

SEQ ID NO: 634 - protein, 546 aa, Small ruminant morbillivirus
  fusion protein
MTRVAILTFLFLFPNAVACQIHWGNLSKIGIVGTGSASYKVMTRPSHQTLVIKLMPNITAIDNCTKSEIAEYKRLLITVLKPVEDALSVITKNVRPIQTLTPGRRTRRFAGAVLAGVALGVATAAQITAGVALHQSLMNSQAIESLKTSLEKSNQAIEEIRLANKETILAVQGVQDYINNELVPSVHRMSCELVGHKLGLKLLRYYTEILSIFGPSLRDPIAAEISIQALSYALGGDINRILDKLGYSGGDFLAILESKGIKARVTYVDTRDYFIILSIAYPTLSEIKGVIVHKIEAITYNIGAQEWYTTIPKYVATQGYLISNFDETSCVFTPDGTVCSQNALYPMSPLLQECFQGSTKSCARTLVSGTISNRFILSKGNLIANCASVLCKCYTTETVISQDPDKLLTVVASDKCPVVEVDGVTIQVGSREYPDSVYLHKIDLGPAISLEKLDVGTNLGNAVTRLENAKELLDASDQILKTVKGVPFGGNMYIALAACIGVSLGLVTLICCCKGRCKNKEVPISKINPGLKPDLTGTSKSYVRSL

SEQ ID NO: 635 - protein, 546 aa, Hendra henipavirus
  fusion protien
MATQEVRLKCLLCGIIVLVLSLEGLGILHYEKLSKIGLVKGITRKYKIKSNPLTKDIVIKMIPNVSNVSKCTGTVMENYKSRLTGILSPIKGAIELYNNNTHDLVGDVKLAGVVMAGIAIGIATAAQITAGVALYEAMKNADNINKLKSSIESTNEAVVKLQETAEKTVYVLTALQDYINTNLVPTIDQISCKQTELALDLALSKYLSDLLFVFGPNLQDPVSNSMTIQAISQAFGGNYETLLRTLGYATEDFDDLLESDSIAGQIVYVDLSSYYIIVRVYFPILTEIQQAYVQELLPVSFNNDNSEWISIVPNFVLIRNTLISNIEVKYCLITKKSVICNQDYATPMTASVRECLTGSTDKCPRELVVSSHVPRFALSGGVLFANCISVTCQCQTTGRAISQSGEQTLLMIDNTTCTTVVLGNIIISLGKYLGSINYNSESIAVGPPVYTDKVDISSQISSMNQSLQQSKDYIKEAQKILDTVNPSLISMLSMIILYVLSIAALCIGLITFISFVIVEKKRGNYSRLDDRQVRPVSNGDLYYIGT

SEQ ID NO: 636 - protein, 565 aa, Murine respirovirus
  fusion protein
MATYIQRVQCISALLSVVLTTLVSCQIPRDRLSNIGVIVDEGKSLKIAGSHESRYIVLSLVPGIDLENGCGTAQVIQYKSLLNRLLIPLRDALDLQEALITVTNDTMTGADVPQSRFFGAVIGTIALGVATSAQITAGIALAEAREAKRDIALIKESMTKTHKSIELLQNAVGEQILALKTLQDFVNDEIKPAISELGCETAALRLGIKLTQHYSELLTAFGSNFGTIGEKSLTLQALSSLYSANITEIMTTIRTGQSNIYDVIYTEQIKGTVIDVDLERYMVTLSVKIPILSEVPGVLIHKASSISYNIDGEEWYVTVPSHILSRASFLGGANIADCVESRLTYICPRDPAQLIPDSQQKCILGDTTRCPVTKVVDNIIPKFAFVNGGVVANCIASTCTCGTGRRPISQDRSKGVVFLTHDNCGLIGVNGIELYANRKGHDATWGVQNLTVGPAIAIRPVDISLNLAAATDFLQDSRAELEKARKILSEVGRWYNSGATLITIIVVMIVVLVVIIVIVIVLYRLRRSMLMSNPAGRISRDTYTLEPKIRHMYTNGGFDAMTEKR

SEQ ID NO: 637 - protein, 555 aa, Human respirovirus 1
  F Glycoprotein
MQKSEILFLVYSSLLLSSSLCQIPVEKLSNVGVIINEGKLLKIAGSYESRYIVLSLVPSIDLQDGCGTTQIIQYKNLLNRLLIPLKDALDLQESLITITNDTTVTNDNPQTRFFGAVIGTIALGVATAAQITAGIALAEAREARKDIALIKDSIVKTHNSVELIQRGIGEQIIALKTLQDFVNDEIRPAIGELRCETTALKLGIKLTQHYSELATAFSSNLGTIGEKSLTLQALSSLYSANITEILSTTKKDKSDIYDIIYTEQVKGTVIDVDLEKYMVTLLVKIPILSEIPGVLIYRASSISYNIEGEEWHVAIPNYIINKASSLGGADVTNCIESKLAYICPRDPTQLIPDNQQKCILGDVSKCPVTKVINNLVPKFAFINGGVVANCIASTCTCGTNRIPVNQDRSRGVTFLTYTNCGLIGINGIELYANKRGRDTTWGNQIIKVGPAVSIRPVDISLNLASATNFLEESKTELMKARAIISAVGGWHNTESTQIIMIIIVCILIIIICGILYYLYRVRRLLVMINSTHNSPVNAYTLESRMRNPYMGNNSN

SEQ ID NO: 638 - protein, 543 aa, Feline morbillivirus
  fusion protein
MGKIRVIIISSLLLSNITTAQVGWDNLTSIGVISTKQYDYKITTLNTNQLMVIKMVPNISSIINCTKPELMKYRELVLGVIRPINESLELMNSYINMRAGSERFIGAVIAGVALGVATAAQITSGIALHNSIMNKRQIQELRKALSTTNKAIDEIRIAGERTLIAVQGVQDYINNIIIPMQDKLQCDILSSQLAIALLRYYTNILTVFGPSIRDPVTSIISIQALSQAFNGNLQALLDGLGYTGRDLRDLLESRSITGQIIHADMTDLFLVLRINYPSITEMQGVTIYELNSITYHIGPEEWYTIMPNFIAVQGFLTSNFDERKCSITKSSILCQQNSIYPMSTEMQRCIKGEIRFCPRSKAVGTLVNRFILTKGNLMANCLGVICRCYSSGQIITQDPSKLITIISQEECKEVGVDGIRIMVGPRKLPDVIFNARLEVGVPISLSKLDVGTDLAIASAKLNNSKALLEQSDKILDSMSKLDSINSRITGLILAIMAIFIITVTIIWIIYKRCRNKDNKFSTSIEPLYIPPSYNSPHSVVKSI

SEQ ID NO: 639 - protein, 534 aa, Avian metaavulavirus 2
  fusion protein
MIAALFISLFATCGALDNSVLAPVGIASAQEWQLAAYTNTLSGTIAVRFVPVLPGNLSTCAQATLAEYNKTVTNILGPLKENLETLLSEPTKTAARFVGAIIGTVALGVATSAQITAAVALNQAQENARNIWRLKESIRKTNEAVLELKDGLASTAIALDKVQKFINEDIIPQIKEIDCQVVANKLGVYLSLYLTELTTIFGAQITNPALTPLSYQALYNLCGGDMGKLTELIGVKAKDINSLYEANLITGQVIGYDSESQIILIQVSYPSVSEVTGVRATELVTVSVTTPKGEGRAIAPKYVAQSRVVTEELDTSTCRFSKTTLYCRSIITRPLPPLIANCLNGLYQDCQYTTEIGALSSRFITVNGGIIANCRATICKCVNPPKIIVQSDASSLTVIDSAICKDVVLDNVQLRLEGKLSAQYFTNITIDLSQITTSGSLDISSEIGSINNTVNKVEELIAESNAWLQAVNPHLVNNTSIIVLCVLAAIFVVWLVALTGCLAYYIKKSSATRMVGIGSSPAGNPYVAQSATKM

SEQ ID NO: 640 - protein, 555 aa, Avian metaavulavirus 6
  fusion protein
MGARLGPLAMAPGRYVIIFNLILLHRVVSLDNSRLLQQGIMSATEREIKVYTNSITGSIAVRLIPNLPQEVLKCSAGQIKSYNDTLNRIFTPIKANLERLLATPSMLEDNQNPAPEPRLIGAIIGTAALGLATAAQVTAALALNQAQDNAKAILNLKESITKTNEAVLELKDATGQIAIALDKTQRFINDNILPAINNLTCEVAGAKVGVELSLYLTELSTVFGSQITNPALSTLSIQALMSLCGNDFNYLLNLMGAKHSDLGALYEANLINGRIIQYDQASQIMVIQVSVPSISSISGLRLTELFTLSIETPVGEGKAVVPQFVVESGQLLEEIDTQACTLTDTTAYCTIVRTKPLPELVAQCLRGDESRCQYTTGIGMLESRFGVFDGLVIANCKATICRCLAPEMIITQNKGLPLTVISQETCKRILIDGVTLQIEAQVSGSYSRNITVGNSQIAPSGPLDISSELGKVNQSLSNVEDLIDQSNQLLNRVNPNIVNNTAIIVTIVLLVLLVLWCLALTISILYVSKHAVRMIKTVPNPYVMQAKSPGSATQF

SEQ ID NO: 641 - protein, 545 aa, Reptilian ferlavirus
  fusion protein F
MTRITILQIILTLTLPVMCQVSFDNLEQVGVMFDKPKFLKITGPASTATMIIKLIPTLGTMESCGTSAVNEYKKTLDTILVPLRDTINKLSTDITVVEGTSNISNKREKRFVGIAIAVGAVALATSAQITAGIALSNTIKNAEAIESIKSSIQASNQAIQKVIDAQGRTVTVINGIQDHINSVINPALNQLGCDVAKNTLAISLTQYFSKLSLLFGPNLRNPVEQPLSVQAIAGLMDGDINAVVSQLGYTQSDLLDLLSTESIVGTVTAIDMVNYMIQIEMSFPQYITIPDTKVLEGHKITFNDKGSEWQTQVPSTIAVRDILIAGVDPDGCSITSTSYICKNDPTYAMSEVLTNCFRGNTQECPRARITSTFATRFAIARSTVIANCVAAVCLCGDPGIPVVQKAEVTLTAMTLDQCSLITVDGLQIKPSKSIANVTANFGNITLGPVVSVGDLDLSAELTKVQSDLKEAQDKLDESNAILQGINNKILTAPTSIALIVVSVVVILLIIGMISWLVWLTKAVRRSNTRSERVTPSAYNNLGFIK

SEQ ID NO: 642 - protein, 566 aa, Avian paraavulavirus 4
  fusion protein
MRLSRTILTLILGTLTGYLMGAHSTNVNEGPKSEGIRGDLIPGAGIFVTQVRQLQIYQQSGYHDLVIRLLPLLPAELNDCQREVVTEYNNTVSQLLQPIKTNLDTLLADGGTRDADIQPRFIGAIIATGALAVATVAEVTAAQALSQSKTNAQNILKLRDSIQATNQAVFEISQGLEATATVLSKLQTELNENIIPSLNNLSCAAMGNRLGVSLSLYLTLMTTLFGDQITNPVLTPISYSTLSAMAGGHIGPVMSKILAGSVTSQLGAEQLIASGLIQSQVVGYDSQYQLLVIRVNLVRIQEVQNTRVVSLRTLAVNRDGGLYRAQVPPEVVERSGIAERFYADDCVLTTTDYICSSIRSSRLNPELVKCLSGALDSCTFERESALLSTPFFVYNKAVVANCKAATCRCNKPPSIIAQYSASALVTITTDTCADLEIEGYRFNIQTESNSWVAPNFTVSTSQIVSVDPIDISSDIAKINSSIEAAREQLELSNQILSRINPRIVNDESLIAIIVTIVVLSLLVIGLIVVLGVMYKNLKKVQRAQAAMMMQQMSSSQPVTTKLGTPF

SEQ ID NO: 643 - protein, 551 aa, Human orthorubulavirus 2
  fusion protein
MHHLHPMIVCIFVMYTGIVGSDAIAGDQLLNIGVIQSKIRSLMYYTDGGASFIVVKLLPNLPPSNGTCNITSLDAYNVTLFKLLTPLIENLSKISTVTDTKTRQKRFAGVVVGLAALGVATAAQITAAVAIVKANANAAAINNLASSIQSTNKAVSDVIDASRTIATAVQAIQDRINGAIVNGITSASCRAHDALIGSILNLYLTELTTIFHNQITNPALTPLSIQALRILLGSTLPIVIESKLNTNFNTAELLSSGLLTGQIISISPMYMQMLIQINVPTFIMQPGAKVIDLIAISANHKLQEVVVQVPNRILEYANELQNYPANDCVVTPNSVFCRYNEGSPIPESQYQCLRGNLNSCTFTPIIGNFLKRFAFANGVLYANCKSLLCRCADPPHVVSQDDTQGISIIDIKRCSEMMLDTFSFRITSTFNATYVTDFSMINANIVHLSPLDLSNQINSINKSLKSAEDWIADSNFFANQARTAKTLYSLSAIALILSVITLVVVGLLIAYIIKLVSQIHQFRSLAATTMFHRENPAFFSKNNHGNIYGIS

SEQ ID NO: 644 - protein, 541 aa, Porcine orthorubulavirus
  fusion protein
MPQQQVAHTCVMLWGIISTVSGINTEALSQYGVVVTNVRQLTYYTQAGSTYLAVRLLPSLASPDQSCALHSIINYNATLQAILSPIAENLNLISTALREQHRKKRFAGVAIGLTALGVATAAQATAAVALVRANKNAEKVEQLSQALGETNAAISDLIDATKNLGFAVQAIQNQINTAILPQIHNLSCQVIDAQLGNILSLYLTELTTVFQPQLTNPALSPLTIQALRAVLGTTLPALLSEKLKSNIPLGDLMSSGLLKGQLVGLNLQNMLMIIELYIPTLSTHSTAKVLDLVTISSHVNGREVEIQVPNRVLELGSEVLGYGGSECALTMSHILCPFNDARVLSTDMKYCLQGNITHCIFSPVVGSFLRRFALVNGVVIANCADMSCVCFDPQEIIYQNFQEPTTVIDIKKCGKVQLDTLTFTISTFANRTYGPPAYVPPDNIIQSEPLDISGNLIAVNNSLSSALNHLATSEILRNEQIWTSSLGISTIVALVIIGILIICLVVTWAALWALLKEVRGLNSAVNSQLSSYVMGDKFIRY

SEQ ID NO: 645 - protein, 551 aa, Mammalian orthorubulavirus 5
  fusion protein
MGTRIQFLMVSCLLAGTGSLDPAALMQIGVIPTNVRQLMYYTEASSAFIVVKLMPTIDSPISGCNITSISSYNATMTKLLQPIGENLETIRYQLIPTRRRRRFVGVVIGLAALGVATAAQVTAAVALVKANKNAAAILNLKNAIQKTNAAVADVVQATQSLGTAVQAVQDHINSVVSPAITAANCKAQDAIIGSILNLYLTELTTIFHNQITNPALSPITIQALRILLGSTLPTVVRKSFNTQISAAELLSSGLLTGQIVGLDLTYMQMVIKIELPTLTVQPATQIIDLVTISAFINNREVMAQLPTRIIVTGSLIQAYPASQCTITPNTVYCRYNDAQVLSDDTMACLQGNLTRCTFSPVVGSFLTRFVLFDGIVYANCRSMLCKCMQPAAVILQPSSSPVTVIDMHKCVSLQLDNLRFTITQLANITYNSTIKLETSQILPIDPLDISQNLAAVNKSLSDALQHLAQSDTYLSAITSATTTSVLSIIAICLGSLGLILIILISVVVWKLLTIVAANRNRMENFVYHNSAFHHSRSDLSEKNQPATLGTR

SEQ ID NO: 646 - protein, 537 aa, Murine orthopneumovirus
  fusion glycoprotein precursor
MIPGRIFLVLLVIFNTKPIHPNTLTEKFYESTCSVETAGYKSALRTGWHMTVMSIKLSQINIESCKSSNSLLAHELAIYSSAVDELRTLSSNALKSKRKKRFLGLILGLGAAVTAGVALAKTVQLESEIALIRDAVRNTNEAVVSLTNGMSVLAKVVDDLKNFISKELLPKINRVSCDVHDITAVIRFQQLNKRLLEVSREFSSNAGLTHTVSSFMLTDRELTSIVGGMAVSAGQKEIMLSSKAIMRRNGLAILSSVNADTLVYVIQLPLFGVMDTDCWVIRSSIDCHNIADKYACLARADNGWYCHNAGSLSYFPSPTDCEIHNGYAFCDTLKSLTVPVTSRECNSNMYTTNYDCKISTSKTYVSTAVLTTMGCLVSCYGHNSCTVINNDKGIIRTLPDGCHYISNKGVDRVQVGNTVYYLSKEVGKSIVVRGEPLVLKYDPLSFPDDKFDVAIRDVEHSINQTRTFLKASDQLLDLSENRENKNLNKSYILTTLLFVVMLIIIMAVIGFILYKVLKMIRDNKLKSKSTPGLTVLS

SEQ ID NO: 647 - protein, 543 aa, Human orthorubulavirus 4
  fusion protein
MGVKGLSLIMIGLLISPITNLDITHLMNLGTVPTAIRSLVYYTYTKPSYLTVDLIPNLKNLDQNCNYSSLNYYNKTALSLIQPIADNINRLTKPITSSEIQSRFFGAVIGTIALGVATAAQVTAAIGLAKAQENAKLILTLKKAATETNEAVRDLANSNKIVVKMISAIQNQINTIIQPAIDQINCQIKDLQVANILNLYLTEITTVFHNQLTNPALESISIQALKSLLGPTLPEVLSKLDLNNISAASVMASGLIKGQIIAVDIPTMTLVLMVQIPSISPLRQAKIIDLTSITIHTNSQEVQAVVPARFLEIGSEILGFDGSVCQITKDTIFCPYNDAYELPIQQKRCLQGQTRDCVFTPVAGTFPRRFLTTYGTIVANCRDLVCSCLRPPQIIYQPDENPVTIIDKDLCTTLTLDSITIEIQKSINSTFRREVVLESTQVRSLTPLDLSTDLNQYNQLLKSAEDHIQRSTDYLNSINPSIVNNNAIIILIILCILLILTVTICIIWLKYLTKEVKNVARNQRLNRDADLFYKIPSQIPVPR

SEQ ID NO: 648 - protein, 538 aa, Tioman pararubulavirus
  fusion protein
MRIALTAVIVSIHFDLAFPMNKNSLLSVGLVHKSVKNLYFYSQGSPSYIVVKLVPTLGNVPGNCTLNSLVRYKSTVSSLLSPLAENLEYLQKTLTVSRGGRRRRFAGVAIGLAALGVAAAAQATAAVALVEARQNAAQIQSLSEAIQNTNLAVNELKTAIGASATAIQAIQTQINEVINPAINRLSCEILDAQLASMLNLYLIHLTTVFQNQLTNPALTPLSIQSLQSLLQGTSSVLTNITSSSKLALNDALVTGLITGQVVGLNMTSLQIVIAAYVPSVAKLSNAVVHNFIRITTSVNGTEVIIQSPTIIMEQNEVMYDLKTGHCTESDLNIYCPYVDAQLLSPGMTNCINGRLNDCTFSKVVGSFPTRFAAVEGAILANCKYLQCNCLTPPYIITPLNGEMISMIDLSKCQRLDLGTIVFDINNPVNVTFNGNYRADVGQMIVTNPLDISAELNQINTSLSNAQGFLSKSDAWLHVSQWVTNSGTIFIILIIGLIVGIVYMIINTYVVVQIIKEINRMRTSDRAHLLKGSISSIST

SEQ ID NO: 649 - protein, 543 aa, Avian metaavulavirus 8
  fusion protein
MGQISVYLINSVLLLLVYPVNSIDNTLIAPIGVASANEWQLAAYTTSLSGTIAVRFLPVLPDNMTTCLRETITTYNNTVNNILGPLKSNLDALLSSETYPQTRLIGAVIGSIALGVATSAQITAAVALKQAQDNARNILALKEALSKTNEAVKELSSGLQQTAIALGKIQSFVNEEILPSINQLSCEVTANKLGVYLSLYLTELTTIFGAQLTNPALTSLSYQALYNLCGGNMAMLTQKIGIKQQDVNSLYEAGLITGQVIGYDSQYQLLVIQVNYPSISEVTGVRATELVTVSVTTDKGEGKAIVPQFVAESRVTIEELDVASCKFSSTTLYCRQVNTRALPPLVASCLRGNYDDCQYTTEIGALSSRYITLDGGVLVNCKSIVCRCLNPSKIISQNTNAAVTYVDATICKTIQLDDIQLQLEGSLSSVYARNISIEISQVTTSGSLDISSEIGNINNTVNRVEDLIHQSEEWLAKVNPHIVNNTTLIVLCVLSALAVIWLAVLTAIIIYLRTKLKTISALAVTNTIQSNPYVNQTKRESKF

SEQ ID NO: 650 - protein, 546 aa, Tailam jeilongvirus
  fusion protein
MKLSVVYTTLLVSTFYSDLARSQLALSELTKIGVIPGRSYDLKISTQASYQYMVVKLIPNLTGLNNCTNGTIEAYKKMLNRLLSPIDAALRKMKDAVNDKPPESVGNVKFWGAVIGGVALGVATSAQITAGVALHNSIQNANAILALKDSIRQSNKAIQELQTAMSTTVVVLNALQDQINNQLVPAINSLGCQVVANTLGLKLNQYFSEISLVFGPNLRDPTSETLSIQALSRAFNGDFDSMLSKLKYDDSDFLDLLESDSIRGRIIDVSLSDYLITIQIEYPALLSIKDAVIQTFNLISYNTRGTEWISIFPKQLLVRGTYISNIDISQCVIAATSIICKSDTSTPISSATWSCATGNITNCARTRVVNAHVPRFALYGGVVFANCAPVVCKCQDPLYSINQEPKVTNVMVDVDACKEMYLDGLYITLGKTQISRAMYAEDVSLGGPISVDPIDLGNEINSINSAINRSEEHLNHANELLDKVNPRIVNVKTFGVMIGLLVLVVLWCVITLVWLICLTKQLARTAYAGSMGSRASTVNSLSGFVG

SEQ ID NO: 651 - protein, 557 aa, Porcine respirovirus 1
  fusion protein
MQVTTLRPAIILSIALLVTGQVPRDKLANLGIIIKDSKALKIAGSYENRYIVLSLVPTIDNVNGCGSIQIAKYKEMLERLLIPIKDALDLQESLIVIDNETVNNNYSPQYRFVGAIIGTIALGVATAAQVTAGVALMEAREAKRDISMLKEAIEKTQNSIEKLQNSAGEQILALKMLQDYVNGEIKPAIEELGCETAALKLGIALTQHYTELTNAFGSNLGSIGEKSLTLQALSSLYKTNITNILTATNLGKTDIYDIIYAEQVKGRVIDVDLKRYMVTISVKIPILSEIPGVLIYEVSSISYNIDGAEWYAAVPDHILSKSAYIGGADISDCIESRLTYICPQDPAQIIADNQQQCFFGHLDKCPITKVIDNLVPKFAFINGGVVANCIASTCTCGEERIQVSQDRNKGVTFLTHNNCGLIGINGIEFHANKKGSDATWNVSPIGVGPAVSLRPVDISLQIVAATNFLNSSRKDLMKAKEILNQVGNLKDLTTITIINIVIIIILLICVIGLGILYHQLRSALGMRDKMSVLNNSSYSLEPRTAQVQVIKPTSFMG

SEQ ID NO: 652 - protein, 538 aa, Avian metapneumovirus
  F protein
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKRRGNYACILREDQGWYCTNAGSTAYYPNKDDCEVRDDYVFCDTAAGINVALEVDQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPVDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 653 - protein, 545 aa, Avian orthoavulavirus 13
  fusion protein
MARFSWEIFRLSTILLIAQTCQGSIDGRLTLAAGIVPVGDRPISIYTSSQTGIIVVKLIPNLPDNKKDCAKQSLQSYNETLSRILTPLATAMSAIRGNSTTQVRENRLVGAIIGSVALGVATAAQITAATALIQANQNAANIARLANSIAKTNEAVTDLTEGLGTLAIGVGKLQDYVNEQFNNTAVAIDCLTLESRLGIQLSLYLTELMGVFGNQLTSPALTPITIQALYNLAGGNLNALLSRLGASETQLGSLINSGLIKGMPIMYDDANKLLAVQVELPSIGKLNGARSTLLETLAVDTTRGPSSPIIPSAVIEIGGAMEELDLSPCITTDLDMFCTKIISYPLSQSTLSCLNGNLSDCVFSRSEGVLSTPYMTIKGKIVANCKQVICRCMDPPQILSQNYGEALLLIDENTCRSLELSGVILKLAGTYESEYTRNLTVDPSQVIITGPLDISAELSKVNQSIDSAKENIAESNKFLSQVNVKLLSSSAMITYIVATVVCLIIAITGCVIGIYTLTKLKSQQKTLLWLGNNAEMHGSRSKTSF

SEQ ID NO: 654 - protein, 554 aa, Menangle pararubulavirus
  fusion protein
MMPRVLGMIVLYLTHSQILCINRNTLYQIGLIHRSVKKVNFYSQGSPSYIVVKLVPTLAAIPPNCSIKSLQRYKETVTSLVQPISDNLGYLQDKLVTGQSRRRRRFAGVAIGLAALGVAAAAQATAAVALVETRENAGKIQALSESIQNTNQAVHSLKTALGFSATAIQAIQNQVNEVINPAINKLSCEVLDSQLASMLNLYLIHLTTVFQTQLTNPALTPLSIQALTSVLQGTSGVLMNSTNSTLTQPIDLLATGLITGQIISVNMTSLQLIIATFMPSIAELPNAVLHSFFRITTSVNLTEVMIQSPEFIMEQNGVFYDFNTAHCQLGDNNVYCPYIDAARLSSMMTNCINGNLGECVFSRVIGSFPSRFVSLNGAILANCKFMRCNCLSPEKIITPLDGEMISLIDLRVCQKLTLGTITFEISQPVNVSFQGGFVANAGQIIVTNPFDISAELGQINNSLNDAQGFLDQSNNWLKVSGWINNSGSLFIAGIVVIGLIVLCIVIIIYINVQIIREVNRLRSFIYRDYVLDHDKAPYSPESSSPHRKSLKTVS

SEQ ID NO: 655 - protein, 544 aa, Avian metaavulavirus 5
  fusion protein
MLQLPLTILLSILSAHQSLCLDNSKLIHAGIMSTTEREVNVYAQSITGSIVVRLIPNIPSNHKSCATSQIKLYNDTLTRLLTPIKANLEGLISAVSQDQSQNSGKRKKRFVGAVIGAAALGLATAAQVTATVALNQAQENARNILRLKNSIQKTNEAVMELKDAVGQTAVAIDKTQAFINNQILPAISNLSCEVLGNKIGVQLSLYLTELTTVFGNQLTNPALTTLSLQALYNLCGDDFNYLINLLNAKNRNLASLYEANLIQGRITQYDSMNQLLIIQVQIPSISTVSGMRVTELFTLSVDTPIGEGKALVPKYVLSSGRIMEEVDLSSCAITSTSVFCSSIISRPLPLETINCLNGNVTQCQFTANTGTLESRYAVIGGLVIANCKAIVCRCLNPPGVIAQNLGLPITIISSNTCQRINLEQITLSLGNSILSTYSANLSQVEMNLAPSNPLDISVELNRVNTSLSKVESLIKESNSILDSVNPQILNVKTVIILAVIIGLIVVWCFILTCLIVRGFMLLVKQQKFKGLSVQNNPYVSNNSH

SEQ ID NO: 656 - protein, 557 aa, Cedar henipavirus
  fusion glycoprotein
MSNKRTTVLIIISYTLFYLNNAAIVGFDFDKLNKIGVVQGRVLNYKIKGDPMTKDLVLKFIPNIVNITECVREPLSRYNETVRRLLLPIHNMLGLYLNNTNAKMTGLMIAGVIMGGIAIGIATAAQITAGFALYEAKKNTENIQKLTDSIMKTQDSIDKLTDSVGTSILILNKLQTYINNQLVPNLELLSCRQNKIEFDLMLTKYLVDLMTVIGPNINNPVNKDMTIQSLSLLFDGNYDIMMSELGYTPQDFLDLIESKSITGQIIYVDMENLYVVIRTYLPTLIEVPDAQIYEFNKITMSSNGGEYLSTIPNFILIRGNYMSNIDVATCYMTKASVICNQDYSLPMSQNLRSCYQGETEYCPVEAVIASHSPRFALTNGVIFANCINTICRCQDNGKTITQNINQFVSMIDNSTCNDVMVDKFTIKVGKYMGRKDINNINIQIGPQIIIDKVDLSNEINKMNQSLKDSIFYLREAKRILDSVNISLISPSVQLFLIIISVLSFIILLIIIVYLYCKSKHSYKYNKFIDDPDYYNDYKRERINGKASKSNNIYYVGD

SEQ ID NO: 657 - protein, 546 aa, Rinderpest morbillivirus
  F protein
MGILFAALLAMTNPHLATGQIHWGNLSKIGVVGTGSASYKVMTQSSHQSLVIKLMPNVTAIDNCTKTEIMEYKRLLGTVLKPIREALNAITKNIKPIQSSTTSRRHKRFAGVVLAGAALGVATAAQITAGIALHQSMMNSQAIESLKASLETTNQAIEEIRQAGQEMVLAVQGVQDYINNELVPAMGQLSCEIVGQKLGLKLLRYYTEILSLFGPSLRDPVSAELSIQALSYALGGDINKILEKLGYSGSDLLAILESKGIKAKITYVDIESYFIVLSIAYPSLSEIKGVIVHRLESVSYNIGSQEWYTTVPRYVATQGYLISNFDDTPCAFTPEGTICSQNALYPMSPLLQECFRGSTRSCARTLVSGSIGNRFILSKGNLIANCASILCKCYTTGSIISQDPDKILTYIAADQCPVVEVGGVTIQVGSREYSDAVYLHEIDLGPPISLEKLDVGTNLWNAVTKLEKAKDLLDSSDLILENIKGVSVTNTGYILVGVGLIAVVGILIITCCCKKRRSDNKVSTMVLNPGLRPDLTGTSKSYVRSL

SEQ ID NO: 658 - protein, 536 aa, Avian metaavulavirus 10
  fusion protein
MTRTRLLFLLTCYIPGAVSLDNSILAPAGIISASERQIAIYTQTLQGTIALRFIPVLPQNLSSCAKDTLESYNSTVSNLLLPIAENLNALLKDADKPSQRIIGAIIGSVALGVATTAQVTAALAMTQAQQNARNIWKLKESIKNTNQAVLELKDGLQQSAIALDKVQSFINSEILPQINQLGCEVAANKLGIFLSLYLTEITTVFKNQITNPALSTLSYQALYNLCGGNMAALTKQIGIKDTEINSLYEAELITGQVIGYDSADQILLIQVSYPSVSRVQGVRAVELLTVSVATPKGEGKAIAPSFIAQSNIIAEELDTQPCKFSKTTLYCRQVNTRTLPVRVANCLKGKYNDCQYTTEIGALASRYVTITNGVVANCRSIICRCLDPEGIVAQNSDAAITVIDRSTCKLIQLGDITLRLEGKLSSSYSKNITIDISQVTTSGSLDISSELGSINNTITKVEDLISKSNDWLSKVNPTLISNDTIIALCVIAGIVVIWLVIITILSYYILIKLKNVALLSTMPKKDLNPYVNNTKF

SEQ ID NO: 659 - protein, 552 aa, Cetacean morbillivirus
  fusion protein
MAASNGGVMYQSFLTIIILVIMTEGQIHWGNLSKIGIVGTGSASYKVMTRPNHQYLVIKLMPNVTMIDNCTRTEVTEYRKLLKTVLEPVKNALTVITKNIKPIQSLTTSRRSKRFAGVVLAGVALGVATAAQITAGVALHQSIMNSQSIDNLRTSLEKSNQAIEEIRQASQETVLAVQGVQDFINNELIPSMHQLSCEMLGQKLGLKLLRYYTEILSIFGPSLRDPVSAEISIQALSYALGGDINKILEKLGYSGADLLAILESRGIKAKVTHVDLEGYFIVLSIAYPTLSEVKGVIVHKLEAVSYNLGSQEWYTTLPKYVATNGYLISNFDESSCAFMSEVTICSQNALYPMSPLLQQCLRGSTASCARSLVSGTIGNRFILSKGNLIANCASVLCKCYSTGTIISQDPDKLLTFVAADKCPLVEVDGITIQVGSREYPDSVYVSRIDLGPAISLEKLDVGTNLGSALTKLDNAKDLLDSSNQILENVRRSSFGGAMYIGILVCAGALVILCVLVYCCRRHCRKRVQTPPKATPGLKPDLTGTTKSYVRSL

SEQ ID NO: 660 - protein, 552 aa, Mossman narmovirus
  fusion protein
MSNYFPARVIIIVSLITAVSCQISFQNLSTIGVFKFKEYDYRVSGDYNEQFLAIKMVPNVTGVENCTASLIDEYRHVIYNLLQPINTTLTASTSNVDPYAGNKKFFGAVIAGVALGVATAAQVTAGVALYEARQNAAAIAEIKESLHYTHKAIESLQISQKQTVVAIQGIQDQINTNIIPQINALTCEIANQRLRLMLLQYYTEMLSSFGPIIQDPLSGHITVQALSQAAGGNITGLMRELGYSSKDLRYILSVNGISANIIDADPEIGSIILRIRYPSMIKIPDVAVMELSYLAYHAAGGDWLTVGPRFILKRGYSLSNLDITSCTIGEDFLLCSKDVSSPMSLATQSCLRGDTQMCSRTAVQDREAPRFLLLQGNLIVNCMSVNCKCEDPEETITQDPAYPLMVLGSDTCKIHYIDGIRIKLGKVQLPPITVLNTLSLGPIVVLNPIDVSNQLSLVETTVKESEDHLKNAIGALRSQSRVGGVGIVAIVGLIIATVSLVVLVISGCCLVKYFSRTATLESSLTTIEHGPTLAPKSGPIIPTYINPVYRHD

SEQ ID NO: 661 - protein, 544 aa, Jun jeilongvirus
  fusion protein
MKPVALIYLTILAFTVKVRSQLALSDLTKIGIIPAKSYELKISTQAAQQLMVIKLIPNVNGLTNCTIPVMDSYKKMLDRILKPIDDALNHVKNAIQDKQGDGVPGVRFWGAIIGGVALGVATSAQITAGVALHNSIQNANAILQLKESIRNSNKAIEELQAGLQSTVLVINALQDQINSQLVPAINTLGCSVIANTLGLRLNQYFSEISLVFGPNLRDPTSQTLSIQAIAKAFNGDFDSMMKKMHYTDSDFLDLLESDSIRGRIISVSLEDYLIIIQIDYPGLTTIPNSVVQTFNLITYNYKGTEWESIFPRELLIRGSYISNIDISQCVGTSKSMICKSDTSTTISPATWACATGNLTSCARTRVVNSHSTRFALSGGVLFANCAPIACRCQDPQYSINQEPKTTNVMVTSEDCKELYIDGFYLTLGKKMLDRAMYAEDVALGGSVSVDPIDIGNELNSINESINKSHEYLDKANELLEQVNPNIVNVSSFSFILVISILLIIWFIVTLVWLIYLTKHMNFIVGKVAMGSRSSTVNSLSGFVG

SEQ ID NO: 662 - protein, 537 aa, Mapuera orthorubulavirus
  fusion protein
MRSSLFLVLTLLVPFAHSIDSITLEQYGTVITSVRSLAYFLETNPTYISVRLMPAIQTDSSHCSYHSIENYNLTLTKLLLPLQENLHQITDSLSSRRRKKRFAGVAVGLAALGVATAAQVTAAIAVVKAKENSAKIAQLTSAISETNRAVQDLIEGSKQLAVAVQAIQDQINNVIQPQLTNLSCQVADAQVGTILNMYLTELTTVFHPQITNSALTPITIQALRSLLGSTLPQVVTSTIKTDVPLQDLLTSGLLKGQIVYLDLQSMIMVVSVSVPTIALHSMAKVYTLKAISAHVNNAEVQMQVPSRVMELGSEIMGYDIDQCEETSRYLFCPYNGGSILSATMKMCLNGNISQCVFTPIYGSFLQRFVLVDGVIVANCRDMTCACKSPSKIITQPDSLPVTIIDSTSCSNLVLDTLELPIISINNATYRPVQYVGPNQIIFSQPLDLLSQLGKINSSLSDAIEHLAKSDEILEQIQWDSPQGYTLIALTSVLAFVVVAIVGLLISTRYLIFEIRRINTTLTQQLSSYVLSNKIIQY

SEQ ID NO: 663 - protein, 566 aa, Nariva narmovirus
  fusion protein
MAEQEKTPLRYKILLIIIVINHYNITNVFGQIHLANLSSIGVFVTKTLDYRTTSDPTEQLLVINMLPNISNIQDCAQGVVNEYKHLISSLLTPINDTLDLITSNINPYSGRNKLFGEIIAGAALTVATSAQITAGVALYEARQNAKDIAAIKESLGYAYKAIDKLTTATREITVVINELQDQINNRLIPRINDLACEVWATRLQAMLLQYYAEIFSVIGPNLQDPLSGKISIQALARAAGGNIKLMVDELNYSGQDLSRLVKVGAIKGQIIDADPSLGVVIIKMRYPNIIKIPNVAISELSYVSYSSDGQDWITTGPNYIVTRGYSIANIQTSSCSVGDDFVLCDRDMTYPMSQVTQDCLRGNIALCSRMVVRDREAPRYLILQGNMVANCMSITCRCEEPESEIYQSPDQPLTLLTRDTCDTHVVDGIRIRLGVRKLPTISVINNITLGPIITTDPIDVSNQLNAVVSTIDQSAELLHQAQRVLSERARGARDHILATAAIVICVVLAVLILVLLIGLVYLYRTQNEILVKTTMLEQVPTFAPKSFPMESQIYSGKTNKGYDPAE

SEQ ID NO: 664 - protein, 662 aa, Ghanaian bat henipavirus
  fusion protein
MKKKTDNPTISKRGHNHSRGIKSRALLRETDNYSNGLIVENLVRNCHHPSKNNLNYTKTQKRDSTIPYRVEERKGHYPKIKHLIDKSYKHIKRGKRRNGHNGNIITIILLLILILKTQMSEGAIHYETLSKIGLIKGITREYKVKGTPSSKDIVIKLIPNVTGLNKCTNISMENYKEQLDKILIPINNIIELYANSTKSAPGNARFAGVIIAGVALGVAAAAQITAGIALHEARQNAERINLLKDSISATNNAVAELQEATGGIVNVITGMQDYINTNLVPQIDKLQCSQIKTALDISLSQYYSEILTVFGPNLQNPVTTSMSIQAISQSFGGNIDLLLNLLGYTANDLLDLLESKSITGQITYINLEHYFMVIRVYYPIMTTISNAYVQELIKISFNVDGSEWVSLVPSYILIRNSYLSNIDISECLITKNSVICRHDFAMPMSYTLKECLTGDTEKCPREAVVTSYVPRFAISGGVIYANCLSTTCQCYQTGKVIAQDGSQTLMMIDNQTCSIVRIEEILISTGKYLGSQEYNTMHVSVGNPVFTDKLDITSQISNINQSIEQSKFYLDKSKAILDKINLNLIGSVPISILFIIAILSLILSIITFVIVMIIVRRYNKYTPLINSDPSSRRSTIQDVYIIPNPGEHSIRSAARSIDRDRD

SEQ ID NO: 665 - protein, 539 aa, Avian paramyxovirus 7
  fusion protein
MRVRPLIIILVLLVLLWLNILPVIGLDNSKIAQAGIISAQEYAVNVYSQSNEAYIALRTVPYIPPHNLSCFQDLINTYNTTIQNIFSPIQDQITSITSASTLPSSRFAGLVVGAIALGVATSAQITAAVALTKAQQNAQEIIRLRDSIQNTINAVNDITVGLSSIGVALSKVQNYLNDVINPALQNLSCQVSALNLGIQLNLYLTEITTIFGPQITNPSLTPLSIQALYTLAGDNLMQFLTRYGYGETSVSSILESGLISAQIVSFDKQTGIAILYVTLPSIATLSGSRVTKLMSVSVQTGVGEGSAIVPSYVIQQGTVIEEFIPDSCIFTRSDVYCTQLYSKLLPDSILQCLQGSMADCQFTRSLGSFANRFMTVAGGVIANCQTVLCRCYNPVMIIPQNNGIAVTLIDGSLCKELELEGIRLTMADPVFASYSRDLIINGNQFAPSDALDISSELGQLNNSISSATDNLQKAQESLNKSIIPAATSSWLIILLFVLVSISLVIGCISIYFIYKHSTTNRSRNLSSDIISNPYIQKAN

SEQ ID NO: 666 - protein, 539 aa, Tuhoko pararubulavirus 2
  fusion protein
MAPCVLFLSSLLLISTISPSHGINQPALRRIGAIVSSVKQLKFYSKTKPNYIIVKLLPTINLSKSNCNLTSINRYKESVIEIIKPLADNIDNLNQKLLPKNRRKRMAGVAIGLAALGVAAAAQATAAVALVEARKNTQMIQSLADSIQDTNAAVQAVNIGLQNSAVAIQAIQNQINNVINPALDRLNCEVLDAQIASILNLYLIKSVTIFQNQLTNPALQQLSIQMLSIVMQDTAKILGNFTIGDKFDQHDLLGSGLITGQVVGVNLTNLQLIIAAFIPSIAPLPQAYIIDLISITISVNDTEAVIQIPERIMEHGSSIYQFGGKQCVYGQFSAYCPFSDAVLMTQDLQLCMKGNIEHCIFSSVLGSFPNRFASVDGVFYANCKYMSCACSDPLQVIHQDDSVNLMVIDSSVCRSLTLGHVTFPIIAFSNVSYQMKTNISIEQMIVTSPLDLSTELKQINNSVNIANTFLDSSNRALKTSIFGTSSQIILIVLLIFTCLLILYVIFLTYIIKILIKEVKRLRDGNSRTGSKLSFINPDV

SEQ ID NO: 667 - protein, 537 aa, Tuhoko pararubulavirus 3
  fusion protein
MLWLTILIALVGNHESTCMNINFLQSLGQINSQKRFLNFYTQQPPSYMVIRLVPTLQLSANNCTLGSIVRYRNAIKELIQPMDENLRWLSSNLIPQRRGKRFAGVAVGLAALGVAVAAQATAAVALVEARANAEKIASMSQSIQETNKAVTSLSQAVSASGIAIQAIQNEINNVIHPILNQVQCDVLDARVGNILNLYLIKVTTIFQNQLTNPALQRLSTQALSMLMQSTSSYLRNLSSSESAINADLSMTNLIEAQIVGINMTNLQLVLAVFIPSIARLNGALLYDFISITISSNQTEVMLQIPHRVLEIGNSLYTFEGTQCEMTKLNAYCLYSDAIPVTESLRDCMNGLFSQCGFVRIIGSFANRFASVNGVIYANCKHLTCSCLQPDEIITQDTNVPLTIIDTKRCTKISLGHLTFTIREYANVTYSLRTEIANSQITVVSPLDLSSQLTTINNSLADATNHIMNSDRILDRLNSGLYSKWVIIFLICASIVSLIGLVFLGFLIRGLILELRSKHRSNLNKASTYSIDSSIGLT

SEQ ID NO: 668 - protein, 545 aa, Mojiang henipavirus
  fusion protein
MALNKNMFSSLFLGYLLVYATTVQSSIHYDSLSKVGVIKGLTYNYKIKGSPSTKLMVVKLIPNIDSVKNCTQKQYDEYKNLVRKALEPVKMAIDTMLNNVKSGNNKYRFAGAIMAGVALGVATAATVTAGIALHRSNENAQAIANMKSAIQNTNEAVKQLQLANKQTLAVIDTIRGEINNNIIPVINQLSCDTIGLSVGIRLTQYYSEIITAFGPALQNPVNTRITIQAISSVFNGNFDELLKIMGYTSGDLYEILHSELIRGNIIDVDVDAGYIALEIEFPNLTLVPNAVVQELMPISYNIDGDEWVTLVPRFVLTRTTLLSNIDTSRCTITDSSVICDNDYALPMSHELIGCLQGDTSKCAREKVVSSYVPKFALSDGLVYANCLNTICRCMDTDTPISQSLGATVSLLDNKRCSVYQVGDVLISVGSYLGDGEYNADNVELGPPIVIDKIDIGNQLAGINQTLQEAEDYIEKSEEFLKGVNPSIITLGSMVVLYIFMILIAIVSVIALVLSIKLTVKGNVVRQQFTYTQHVPSMENINYVSH

SEQ ID NO: 669 - protein, 546 aa, Avian paramyxovirus 12
  fusion protein
MAIPVPSSTALMIFNILVSLAPASALDGRLLLGAGIVPTGDRQVNVYTSSQTGIIALKLLPNLPKDKENCAEVSIRSYNETLTRILTPLAQSMAAIRGNSTVSTRGREPRLVGAIIGGVALGVATAAQITAATALIQANQNAENIARLAKGLAATNEAVTDLTKGVGSLAIGVGKLQDYVNEQFNRTGEAIECLTIESRVGVQLSLYLTEVIGVFGDQITSPALSDISIQALYNLAGGNLNVLLQKMGIEGTQLGSLINSGLIKGRPIMYDDGNKILGIQVTLPSVGRINGARATLLEAIAVATPKGNASPLIPRAVISVGSLVEELDMTPCVLTPTDIFCTRILSYPLSDSLTTCLKGNLSSCVFSRTEGALSTPYVSVHGKIVANCKSVVCRCVEPQQIISQNYGEALSLIDESLCRILELNGVILKMDGQFTSEYTKNITIDPVQVIISGPIDISSELSQVNQSLDSALENIKESNSYLSKVNVKLISSSAMITYIVITVICLILTFVALVLGIYSYTKIRSQQKTLIWMGNNIARSKEGNRF

SEQ ID NO: 670 - protein, 538 aa, Avian paramyxovirus 3
  fusion protein
  MOD_RES (287)..(287): Any naturally occurring amino acid
MASPMVPLLIITVVPALISSQSANIDKLIQAGIIMGSGKELHIYQESGSLDLYLRLLPVIPSNLSHCQSEVITQYNSTVTRLLSPIAKNLNHLLQPRPSGRLFGAVIGSIALGVATSAQISAAIALVRAQQNANDILALKAAIQSSNEAIKQLTYGQEKQLLAISKIQKAVNEQVIPALTALDCAVLGNKLAAQLNLYLIEMTTIFGDQINNPVLTPIPLSYLLRLTGSELNDVLLQQTRSSLSLIHLVSKGLLSGQIIGYDPSVQGIIIRIGLIRTQRIDRSLVFXPYVLPITISSNIATPIIPDCVVKKGVIIEGMLKSNCIELERDIICKTINTYQITKETRACLQGNITMCKYQQSRTQLSTPFITYNGVVIANCDLVSCRCIRPPMIITQVKGYPLTIINRNLCTELSVDNLILNIETNHNFSLNPTIIDSQSRLIATSPLEIDALIQDAQHHAAAALLKVEESNAHLLRVTGLGSSSWHIILILTLLVCTIAWLIGLSIYVCRIKNDDSTDKEPTTQSSNRGIGVGSIQYMT

SEQ ID NO: 671 - protein, 552 aa, Salem salemvirus
  fusion protein
MNPLNQTLIAKVLGFLLLSSSFTVGQIGFENLTRIGVHQVKQYGYKLAHYNSHQLLLIRMIPTVNGTHNCTHQVITRYREMVREIITPIKGALDIMKKAVSPDLVGARIFGAIVAGAALGIATSAQITAGVALHRTKLNGQEISKLKEAVSLTNEAVEQLQYSQGKSILAIQGIQDFINFNVVPLLEEHTCGIAKLHLEMALMEYFQKLILVFGPNLRDPIGSTIGIQALATLFQNNMFEVSLRLGYAGDDLEDVLQSNSIRANIIEAEPDSGFIVLAIRYPTLTLVEDQVITELAHITFNDGPQEWVATIPQFVTYRGLVLANIDVSTCTFTERNVICARDQTYPMIIDLQLCMRGNIAKCGRTRVTGSTASRFLLKDGNMYANCIATMCRCMSSSSIINQEPSHLTTLIVKETCSEVMIDTIRITLGERKHPPIDYQTTITLGQPIALAPLDVGTELANAVSYLNKSKVLLEHSNEVLSSVSTAHTSLTATIVLGIVVGGLAILIVVMFLFLEAQVIKVQRAMMLCPITNHGYLPNEDLLTRGHSIPTIG

SEQ ID NO: 672 - protein, 551 aa, Avian paramyxovirus 9
  fusion protein
MGYFHLLLILTAIAISAHLCYTTTLDGRKLLGAGIVITEEKQVRVYTAAQSGTIVLRSFRVVSLDRYSCMESTIESYNKTVYNILAPLGDAIRRIQASGVSVERIREGRIFGAILGGVALGVATAAQITAAIALIQANENAKNILRIKDSITKTNEAVRDVTNGVSQLTIAVGKLQDFVNKEFNKTTEAINCVQAAQQLGVELSLYLTEITTVFGPQITSPALSKLTIQALYNLAGVSLDVLLGRLGADNSQLSSLVSSGLITGQPILYDSESQILALQVSLPSISDLRGVRATYLDTLAVNTAAGLASAMIPKVVIQSNNIVEELDTTACIAAEADLYCTRITTFPIASAVSACILGDVSQCLYSKTNGVLTTPYVAVKGKIVANCKHVTCRCVDPTSIISQNYGEAATLIDDQLCKVINLDGVSIQLSGTFESTYVRNVSISANKVIVSSSIDISNELENVNSSLSSALEKLDESDAALSKVNVHLTSTSAMATYIVLTVIALILGFVGLGLGCFAMIKVKSQAKTLLWLGAHADRSYILQSKPAQSST

SEQ ID NO: 673 - protein, 533 aa, Achimota pararubulavirus 1
  fusion protein
MWIMIILSLFQIIPGVTPINSKVLTQLGVITKHTRQLKFYSHSTPSYLVVKLVPTINTESTVCNFTSLSRYKDSVRELITPLAKNIDNLNSILTIPKRRKRMAGVVIGLAALGVAAAAQATAAVALIEAKKNTEQIQALSESIQNTNKAVSSIEKGLSSAAIAVQAIQNQINNVINPALTALDCGVTDAQLGNILNLYLIKTLTVFQKQITNPALQPLSIQALNIIMQETSSVLRNFTKTDEIEHTDLLTSGLITGQVVGVNLTNLQLIIAAFIPSIAPLNQAYILDFIRITVNINNSESMIQIPERIMEHGISLYQFGGDQCTFSDWSAYCPYSDATLMAPGLQNCFRGQAADCVFSTVMGSFPNRFVSVQGVFYVNCKFIRCACTQPQRLITQDDSLSLTQIDAKTCRMLTLGFVQFSINEYANVTYSFKNNVTAGQLIMTNPIDLSTEIKQMNDSVDEAARYIEKSNAALNKLMYGGRSDIVTTVLLVGFILLVVYVIFVTYILKILMKEVARLRNSNHPDLIKPYNYPM

SEQ ID NO: 674 - protein, 531 aa, Achimota pararubulavirus 2
  fusion protein
MLNSFYQIICLAVCLTTYTVISIDQHNLLKAGVIVKSIKGLNFYSRGQANYIIVKLIPNVNVTDTDCDIGSIKRYNETVYSLIKPLADNIDYLRTQFAPTKRKKRFAGVAIGLTALGVATAAQVTAAVALVKAQENARKLDALADSIQATNEAVQDLSTGLQAGAIAIQAIQSEINHVINPALERLSCEIIDTRVASILNLYLIRLTTVFHRQLVNPALTPLSIQALNHLLQGETEGLVKNESKMTDSKIDLLMSGLITGQVVGVNIKHMQLMIAVFVPTTAQLPNAYVINLLTITANINNSEVLVQLPNQILERSGIIYQFRGKDCVSSPNHMYCPYSDASILSPELQLCLQGRLEMCLFTQVVGSFPTRFASDKGIVYANCRHLQCACSEPEGIIYQDDTSAITQIDASKCSTLKLDMLTFKLSTYANKTFDASFSVGKDQMLVTNLLDLSAELKTMNASVAHANKLIDKSNLLIQSNALIGHSNTIFIVVIVILAVMVLYLIIVTYIIKVIMVEVSRLKRMNIYSIDK

SEQ ID NO: 675 - protein, 532 aa, Tuhoko pararubulavirus 1
  fusion protein
MVTIIKPLILLVTVILQISGHIDTTALTSIGAVIASSKEIMYYAQSTPNYIVIKLIPNLPNIPSQCNFSSIAYYNKTLLDLFTPISDNINMLHQRLSNTGRNRRFAGVAIGLAALGVATAAQVTAAFALVEAKSNTAKIAQIGQAIQNTNAAINSLNAGIGGAVTAIQAIQTQINGIITDQINAATCTALDAQIGTLLNMYLLQLTTTFQPQIQNPALQPLSIQALHRIMQGTSIVLSNLTDSSKYGLNDALSAGLITGQIVSVDLRLMQITIAANVPTLSRLENAIAHDIMRITTNVNNTEVIVQLPETIMEHAGRLYQFNKDHCLSSTQRFFCPYSDAKLLTSKISSCLSGIRGDCIFSPVVGNFATRFISVKGVIIANCKFIRCTCLQPEGIISQLDDHTLTVIDLKLCNKLDLGLIQFDLQVLSNISYEMTLNTSQNQLILTDPLDLSSELQTMNQSINNAANFIEKSNSLLNSSTYEFNRSVALLVALILLSLTILYVIVLTCVVKLLVHEVSKNRRHIQDLESHHK

SEQ ID NO: 676 - protein, 631 aa, Phocine morbillivirus
  fusion protein
MTRVKKLPVPTNPPMHHSLDSPFLNPEHATGKISITDDTSSQLTNFLYHKYHKTTINHLSRTISGTDPPSAKLNKFGSPILSTYQIRSALWWIAMVILVHCVMGQIHWTNLSTIGIIGTDSSHYKIMTRSSHQYLVLKLMPNVSIIDNCTKAELDEYEKLLNSVLEPINQALTLMTKNVKSLQSLGSGRRQRRFAGVVIAGAALGVATAAQITAGVALYQSNLNAQAIQSLRASLEQSNKAIDEVRQASQNIIIAVQGVQDYVNNEIVPALQHMSCELIGQRLGLKLLRYYTELLSVFGPSLRDPVSAEISIQALSYALGGEIHKILEKLGYSGNDMVAILETKGIRAKITHVDLSGKFIVLSISYPTLSEVKGVVVHRLEAVSYNIGSQEWYTTVPRYVATNGYLISNFDESSCVFVSESAICSQNSLYPMSPILQQCLRGETASCARTLVSGTLGNKFILSKGNIIANCASILCKCHSTSKIINQSPDKLLTFIASDTCSLVEIDGVTIQVGSRQYPDVVYASKVILGPAISLERLDVGTNLGSALKKLNDAKVLIESSDQILDTVKNSYLSLGTLIALPVSIGLGLILLLLICCCKKRYQHLFSQSTKVAPVFKPDLTGTSKSYVRSL

SEQ ID NO: 677 - protein, 541 aa, Caprine respirovirus 3
  fusion protein
MIKKIICIFSMPILLSFCQVDIIKLQRVGILVSKPKSIKISQNFETRYLVLNLIPNIENAQSCGDQQIKQYKKLLDRLIIPLYDGLRLQQDIIVVDNNLKNNTNHRAKRFFGEIIGTIALGVATSAQITAAVALVEAKQARSDIERVKNAVRDTNKAVQSIQGSVGNLIVAVKSVQDYVNNEIVPSIKRLGCEAAGLQLGIALTQHYSELTNIFGDNIGTLKEKGIKLQGIASLYHTNITEIFTTSTVDQYDIYDLLFTESIKMRVIDVDLNDYSITLQVRLPLLTKISDAQIYNVDSVSYNIGGTEWYIPLPRNIMTKGAFLGGANLQDCIESFSDYICPSDPGFILNRDIENCLSGNITQCPKTLVISDIVPRYAFVDGGVIANCLSTTCTCNGIDNRINQAPDQGIKIITYKDCQTIGINGMLFKTNQEGTLAAYTPVDITLNNSVNLDPIDLSIELNRARSDLAESKEWIKRSEAKLDSVGSWYQSSTTEIIQIVMIIVLFIINIIVLIVLIKYSRSQNQSMNNHMNEPYILTNKVQ

SEQ ID NO: 678 - protein, 553 aa, Tupaia narmovirus
  fusion protein
MASLLKTICYIYLITYAKLEPTPKSQLDLDSLASIGVVDAGKYNYKLMTTGSEKLMVIKLVPNITYATNCNLTAHTAYTKMIERLLTPINQSLYEMRSVITERDGGTIFWGAIIAGAALGVATAAAITAGVALHRAEQNARNIAALKDALRNSNEAIQHLKDAQGHTVLAIQGLQEQINNNIIPKLKESHCLGVNNQLGLLLNQYYSEILTVFGPNLQNPVSASLTIQAIAKAFNGDFNSLMTNLNYDPTDLLDILESNSINGRIIDVNLNEKYIALSIEIPNFITLTDAKIQTFNRITYGYGSNEWLTLIPDNILEYGNLISNVDLTSCVKTKSSYICNQDTSYPISSELTRCLRGDTSSCPRTPVVNSRAPTFALSGGHIYANCAKAACRCEKPPMAIVQPATSTLTFLTEKECQEVVIDQINIQLAPNRLNKTIITDGIDLGPEVIINPIDVSAELGNIELEMDKTQKALDRSNKILDSMITEVTPDKLLIAMIVVFGILLLWLFGVSYYAFKIWSKLHFLDSYVYSLRNPSHHRSNGHQNHSFSTDISG

SEQ ID NO: 679 - protein, 543 aa, Avian paramyxovirus 3
  fusion protein
MQPGSALHLPHLYIIIALVSDGTLGQTAKIDRLIQAGIVLGSGKELHISQDSGTLDLFVRLLPVLPSNLSHCQLEAITQYNKTVTRLLAPIGKNLEQVLQARPRGRLFGPIIGSIALGVATSAQITAAIALVRAQQNANDILALKNALQSSNEAIRQLTYGQDKQLLAISKIQKAVNEQILPALDQLDCAVLGTKLAVQLNLYLIEMTTIFGEQINNPVLATIPLSYILRLTGAELNNVLMKQARSSLSLVQLVSKGLLSGQVIGYDPSVQGLIIRVNLMRTQKIDRALVYQPYVLPITLNSNIVTPIAPECVIQKGTIIEGMSRKDCTELEQDIICRTVTTYTLARDTRLCLQGNISSCRYQQSGTQLHTPFITYNGAVIANCDLVSCRCLRPPMIITQVKGYPLTIITRSVCQELSVDNLVLNIETHHNFSLNPTIIDPLTRVIATTPLEIDSLIQEAQDHANAALAKVEESDKYLRAVTGGNYSNWYIVLVIVLLFGNLGWSLLLTVLLCRSRKQQRRYQQDDSVGSERGVGVGTIQYMS

SEQ ID NO: 680 - protein, 541 aa, Avian metaavulavirus 14
  fusion protein
MEKGTVLFLAALTLYNVKALDNTKLLGAGIASGKEHELKIYQSSVNGYIAVKLIPFLPSTKRECYNEQLKNYNATINRLMGPINDNIKLVLSGVKTRTREGKLIGAIIGTAALGLATAAQVTAAIALEQAQDNARAILTLKESIRNTNNAVSELKTGLSEVSIALSKTQDYINTQIMPALSNLSCEIVGLKIGIQLSQYLTEVTAVFGNQITNPALQPLSMQALYQLCGGDFSLLLDKIGADRNELESLYEANLVTGRIVQYDTADQLVIIQVSIPSVSTLSGYRVTELQSISVDMDHGEGKAVIPRYIVTSGRVIEEMDISPCVLTATAVYCNRLLTTSLPESVLKCLDGDHSSCTYTSNSGVLETRYIAFDGMLIANCRSIVCKCLDPPYIIPQNKGKPLTIISKEVCKKVTLDGITLLIDAEFTGEYGLNITIGPDQFAPSGALDISTELGKLNNSINKAEDYIDKSNELLNRVNVDIVNDTAVIVLCVMSALVVVWCIGLTVGLIYVSKNTLRAVAIKGTSIENPYVSSGKHAKNSS

SEQ ID NO: 681 - protein, 551 aa, Avian orthoavulavirus 16
  fusion protein
MIFTMYHVTVLLLLSLLTLPLGIQLARASIDGRQLAAAGIVVTGEKAINLYTSSQTGTIVVKLLPNVPQGREACMRDPLTSYNKTLTSLLSPLGEAIRRIHESTTETAGLVQARLVGAIIGSVALGVATSAQITAAAALIQANKNAENILKLKQSIAATNEAVHEVTDGLSQLAVAVGKMQDFINTQFNNTAQEIDCIRISQQLGVELNLYLTELTTVFGPQITSPALSPLSIQALYNLAGGNLDVLLSKIGVGNNQLSALISSGLISGSPILYDSQTQLLGIQVTLPSVSSLNNMRAIFLETLSVSTDKGFAAALIPKVVTTVGTVTEELDTSYCIETDIDLFCTRIVTFPMSPGIYACLNGNTSECMYSKTQGALTTPYMSVKGSIVANCKMTTCRCADPASIISQNYGEAVSLIDSSVCRVITLDGVTLRLSGSFDSTYQKNITIRDSQVIITGSLDISTELGNVNNSINNALDKIEESNQILESVNVSLTSTNALIVYIICTALALICGITGLILSCYIMYKMRSQQKTLMWLGNNTLDQMRAQTKM

SEQ ID NO: 682 - protein, 552 aa, Aquaparamyxovirus
  fusion protein
MDGPKFRFVLLILLTAPARGQVDYDKLLKVGIFEKGTANLKISVSSQQRYMVIKMMPNLGPMNQCGIKEVNLYKESILRLITPISTTLNYIKSEIQVEREVALQPNGTIVRFFGLIVAAGALTLATSAQITAGIALHNSLENAKAIKGLTDAIKESNLAIQKIQDATAGTVIALNALQDQVNTNIIPAINTLGCTAAGNTLGIALTRYYSELIMIFGPSLGNPVEAPLTIQALAGAFNGDLHGMIREYGYTPSDIEDILRTNSVTGRVIDVDLVGMNIVLEINLPTLYTLRDTKIVNLGKITYNVDGSEWQTLVPEWLAIRNTLMGGVDLSRCVVSSRDLICKQDPVFSLDTSIISCLNGNTESCPRNRVVNSVAPRYAVIRGNILANCISTTCLCGDPGVPIIQKGDNTLTAMSINDCKLVGVDGYVFRPGPKAVNVTFNLPHLNLGPEVNVNPVDISGALGKVEQDLASSRDHLAKSEKILSGINPNIINTEMVLVAVILSLVCAMVVIGIVCWLSILTKWVRSCRADCRRPNKGPDLGPIMSSQDNLSF

SEQ ID NO: 683 - protein, 546 aa, Nipah henipavirus
  Fusion glycoprotein F0
MVVILDKRCYCNLLILILMISECSVGILHYEKLSKIGLVKGVTRKYKIKSNPLTKDIVIKMIPNVSNMSQCTGSVMENYKTRLNGILTPIKGALEIYKNNTHDLVGDVRLAGVIMAGVAIGIATAAQITAGVALYEAMKNADNINKLKSSIESTNEAVVKLQETAEKTVYVLTALQDYINTNLVPTIDKISCKQTELSLDLALSKYLSDLLFVFGPNLQDPVSNSMTIQAISQAFGGNYETLLRTLGYATEDFDDLLESDSITGQIIYVDLSSYYIIVRVYFPILTEIQQAYIQELLPVSFNNDNSEWISIVPNFILVRNTLISNIEIGFCLITKRSVICNQDYATPMTNNMRECLTGSTEKCPRELVVSSHVPRFALSNGVLFANCISVTCQCQTTGRAISQSGEQTLLMIDNTTCPTAVLGNVIISLGKYLGSVNYNSEGIAIGPPVFTDKVDISSQISSMNQSLQQSKDYIKEAQRLLDTVNPSLISMLSMIILYVLSIASLCIGLITFISFIIVEKKRNTYSRLEDRRVRPTSSGDLYYIGT

SEQ ID NO: 684 - protein, 321 aa, Human orthopneumovirus
  attachment glycoprotein
MSKTKDQRTAKTLERTWDTLNHLLFISSCLYKLNLKSIAQITLSILAMIISTSLIIAAIIFIASANHKVTLTTAIIQDATNQIKNTTPTYLTQNPQLGISFSNLSGTTLQSTTILASTTPSAESTPQSTTVKIINTTTTQILPSKPTTKQRQNKPQNKPNNDFHFEVFNFVPCSICSNNPTCWAICKRIPNKKPGKKTTTKPTKKPTLKTTKKDPKPQTTKPKEALTTKPTGKPTINTTKTNIRTTLLTSNTKGNPEHTSQEETLHSTTSEGYLSPSQVYTTSGQEETLHSTTSEGYLSPSQVYTTSEYLSQSLSSSNTTK

SEQ ID NO: 685 - protein, 616 aa, Avian orthoavulavirus 1
  hemagglutinin-neuraminidase protein
MERGVSQVALENDEREAKNTWRLVFRVTVLFLTIVTLAISAAALAFSMNASTPQDLEGIPVAISKVEDKITSALGASQDVMDRIYKQVALESPLALLNTESTIMNALTSLSYQINGAANASGCGAPVPDPDYIGGIGKELIVDDTSDVTSFYPSAFQEHLNFIPAPTTGSGCTRIPSFDMSATHYCYTHNVILSGCRDHSHSHQYLALGVLRTSATGRVFFSTLRSINLDDTQNRKSCSVSATPLGCDMLCSKVTETEEEDYQSTDPTLMVHGRLGFDGQYHERDLDVHTLFGDWVANYPGVGGGSFINNRVWFPVYGGLKPGSPTDKRQEGQYAIYKRYNDTCPDDQEYQVRMAKSAYKPNRFGGKRVQQAILSIGVSTTLADDPVLTVTSNTITLMGAEGRVMTVGTSHYLYQRGSSYYSPAILYPLTIANKTATLQDPYKFNAFTRPGSVPCQASARCPNSCVTGVYTDPYPIVFHKNHTLRGVFGTMLDDEQARLNPVSAVFDSIARSRVTRVSSSSTKAAYTTSTCFKVVKTGKVYCLSIAEISNTLFGEFRIVPLLVEILRDEGRSEARSALTTQGHPGWNDEVVDPIFCAVTNQTDHRQKLEEYAQSWP

SEQ ID NO: 686 - protein, 316 aa, Human orthopneumovirus
  receptor-binding glycoprotein
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSETHHTTAQTKGRTTTPTQNNKPSTKPRPKNPPKKPKDDYHFEVFNFVPCSICGNNQLCKSICKTIPNNKPKKKPTTKPTNKPPTKTTNKRDPKTPAKTLKKETTINPTTKKPTPKTTERDTSTPQSTVLDTTTSKHTERDTSTPQSTVLDTTTSKHTIQQQSLHSITPENTPNSTQTPTASEPSTSNSTQKL

SEQ ID NO: 687 - protein, 621 aa, Measles morbillivirus
  Hemagglutinin
MSPHRDRINAFYRDNPHPKGSRIVINREHLMIDRPYVLLAVLFVMFLSLIGLLAIAGIRLHRAAIYTAEIHKSLSTNLDVTNSIEHQVKDVLTPLFKIIGDEVGLRTPQRFTDLVKFISDKIKFLNPDREYDFRDLTWCINPPERIKLDYDQYCADVAAEELMNALVNSTLLEARATNQFLAVSKGNCSGPTTIRGQFSNMSLSLLDLYLSRGYNVSSIVTMTSQGMYGGTYLVGKPNLSSKGSELSQLSMHRVFEVGVIRNPGLGAPVFHMTNYFEQPVSNDFSNCMVALGELRFAALCHREDSVTVPYQGSGKGVSFQLVKLGVWKSPTDMQSWVPLSTDDPVIDRLYLSSHRGVIADNQAKWAVPTTRTDDKLRMETCFQQACKGKNQALCENPEWAPLKDNRIPSYGVLSVNLSLTVELKIKIASGFGPLITHGSGMDLYKTNHDNVYWLTIPPMKNLALGVINTLEWIPRFKVSPNLFTVPIKEAGEDCHAPTYLPAEVDGDVKLSSNLVILPGQDLQYVLATYDTSRVEHAVVYYVYSPSRSFSYFYPFRLPIKGVPIELQVECFTWDQKLWCRHFCVLADSESGGHITHSGMVGMGVSCTVTREDGTNRRQGCQ

SEQ ID NO: 688 - protein, 582 aa, Mumps orthorubulavirus
  hemagglutinin-neuraminidase
MEPSKLFTMSDNATFAPGPVINAADKKTFRTCFRILVLSVQAVTLILVIVTLGELVRMINDQGLSNQLSSIADKIRESATMIASAVGVMNQVIHGVTVSLPLQIEGNQNQLLSTLATICTGKKQVSNCSTNIPLVNDLRFINGINKFIIEDYATHDFSIGHPLNMPSFIPTATSPNGCTRIPSFSLGKTHWCYTHNVINANCKDHTSSNQYISMGILVQTASGYPMFKTLKIQYLSDGLNRKSCSIATVPDGCAMYCYVSTQLETDDYAGSSPPTQKLTLLFYNDTVTERTISPTGLEGNWATLVPGVGSGIYFENKLIFPAYGGVLPNSSLGVKSAREFFRPVNPYNPCSGPQQDLDQRALRSYFPSYFSNRRVQSAFLVCAWNQILVTNCELVVPSNNQTLMGAEGRVLLINNRLLYYQRSTSWWPYELLYEISFTFTNSGQSSVNMSWIPIYSFTRPGSGNCSGENVCPTACVSGVYLDPWPLTPYSHQSGINRNFYFTGALLNSSTTRVNPTLYVSALNNLKVLAPYGNQGLFASYTTTTCFQDTGDASVYCVYIMELASNIVGEFQILPVLTRLTIT

SEQ ID NO: 689 - protein, 572 aa, Human respirovirus 3
  hemagglutinin-neuraminidase
MEYWKHTNHGKDAGNELETATATHGNRLTNKITYILWTITLVLLSIVFIIVLINSIKSEKAHESLLQDINNEFMEVTEKIQVASDNTNDLIQSGVNTRLLTIQSHVQNYIPISLTQQISDLRKFISEITIRNDNQEVPPQRITHDVGIKPLNPDDFWRCTSGLPSLMRTPKIRLMPGPGLLAMPTTVDGCVRTPSLVINDLIYAYTSNLITRGCQDIGKSYQVLQIGIITVNSDLVPDLNPRISHTFNINDNRKSCSLALLNTDVYQLCSTPKVDERSDYASSGIEDIVLDIVNYDGSISTTRFKNNNISFDQPYAALYPSVGPGIYYKGKIIFLGYGGLEHPINENAICNTTGCPGKTQRDCNQASHSPWFSDRRMVNSIIVVDKGLNSVPKLKVWTISMRQNYWGSEGRLLLLGNKIYIYTRSTSWHSKLQLGIIDITDYSDIRIKWTWHNVLSRPGNNECPWGHSCPDGCITGVYTDAYPLNPTGSIVSSVILDSQKSRVNPVITYSTATERVNELAIRNKTLSAGYTTTSCITHYNKGYCFHIVEINHKSLNTFQPMLFKTEIPKSCS

SEQ ID NO: 690 - protein, 220 aa, Human metapneumovirus
  attachment glycoprotein G
MEVKVENIRAIDMLKARVKNRVARSKCFKNASLILIGITTLSIALNIYLIINYTIQKTTSESEHHTSSPPTESNKETSTIPIDNPDITPNSQHPTQQSTESLTLYPASSMSPSETEPASTPGITNRLSLADRSTTQPSESRTKTNSTVHKKNKKNISSTISRTQSPPRTTAKAVSRTTALRMSSTGERPTTTSVQSDSSTTAQNHEETGPANPQASVSTM

SEQ ID NO: 691 - protein, 607 aa, Canine morbillivirus
  hemagglutinin
MLSYQDKVGAFYKDNARANSSKLSLVTEEQGGRRPPYLLFVLLILLVGILALLAIAGVRFRQVSTSNVEFGRLLKDDLEKSEAVHHQVMDVLTPLFKIIGDEIGLRLPQKLNEIKQFILQKTNFFNPNREFDFRDLHWCINPPSKIKVNFTNYCDAIGVRKSIASAANPILLSALSGGRGDIFPPYRCSGATTSVGRVFPLSVSLSMSLISKTSEIISMLTAISDGVYGKTYLLVPDYIEREFDTQKIRVFEIGFIKRWLNDMPLLQTTNYMVLPENSKAKVCTIAVGELTLASLCVDESTVLLYHDSNGSQDSILVVTLGIFGATPMNQVEEVIPVAHPSVERIHITNHRGFIKDSVATWMVPALVSEQQEGQKNCLESACQRKSYPMCNQTSWEPFGGVQLPSYGRLTLPLDASIDLQLNISFTYGPVILNGDGMDYYENPLLDSGWLTIPPKNGTILGLINKASRGDQFTVTPHVLTFAPRESSGNCYLPIQTSQIMDKDVLTESNLVVLPTQNFRYVVATYDISRENHAIVYYVYDPIRTISYTYPFRLTTKGRPDFLRIECFVWDDDLWCHQFYRFESDITNSTTSVEDLVRIRFSCNRSKP

SEQ ID NO: 692 - protein, 609 aa, Small ruminant morbillivirus
  haemagglutinin
MSAQRERINAFYKDNPHNKNHRVILDRERLVIERPYILLGVLLVMFLSLIGLLAIAGIRLHRATVGTSEIQSRLNTNIELTESIDHQTKDVLTPLFKIIGDEVGIRIPQKFSDLVKFISDKIKFLNPDREYDFRDLRWCMNPPERVKINFDQFCEYKAAVKSIEHIFESPLNKSKKLQSLTLGPGTGCLGRTVTRAHFSELTLTLMDLDLEMKHNVSSVFTVVEEGLFGRTYTVWRSDARDPSTDLGIGHFLRVFEIGLVRDLGLGPPVFHMTNYLTVNMSDDYRRCLLAVGELKLTALCSSSETVTLGERGVPKREPLVVVILNLAGPTLGGELYSVLPTSDLMVEKLYLSSHRGIIKDDEANWVVPSTDVRDLQNKGECLVEACKTRPPSFCNGTGSGPWSEGRIPAYGVIRVSLDLASDPGVVITSVFGPLIPHLSGMDLYNNPFSRAVWLAVPPYEQSFLGMINTIGFPNRAEVMPHILTTEIRGPRGRCHVPIELSRRVDDDIKIGSNMVILPTIDLRYITATYDVSRSEHAIVYYIYDTGRSSSYFYPVRLNFKGNPLSLRIECFPWRHKVWCYHDCLIYNTITDEEVHTRGLTGIEVTCNPV

SEQ ID NO: 693 - protein, 575 aa, Murine respirovirus
  hemagglutinin-neuraminidase protein
MDGDRSKRDSYWSTSPGGSTTKLVSDSERSGKVDTWLLILAFTQWALSIATVIICIVIAARQGYSMERYSMTVEALNTSNKEVKESLTSLIRQEVITRAANIQSSVQTGIPVLLNKNSRDVIRLIEKSCNRQELTQLCDSTIAVHHAEGIAPLEPHSFWRCPAGEPYLSSDPEVSLLPGPSLLSGSTTISGCVRLPSLSIGEAIYAYSSNLITQGCADIGKSYQVLQLGYISLNSDMFPDLNPVVSHTYDINDNRKSCSVVATGTRGYQLCSMPIVDERTDYSSDGIEDLVLDILDLKGRTKSHRYSNSEIDLDHPFSALYPSVGSGIATEGSLIFLGYGGLTTPLQGDTKCRIQGCQQVSQDTCNEALKITWLGGKQVVSVLIQVNDYLSERPRIRVTTIPITQNYLGAEGRLLKLGDQVYIYTRSSGWHSQLQIGVLDVSHPLTISWTPHEALSRPGNEDCNWYNTCPKECISGVYTDAYPLSPDAANVATVTLYANTSRVNPTIMYSNTTNIINMLRIKDVQLEAAYTTTSCITHFGKGYCFHIIEINQKSLNTLQPMLFKTSIPKLCKAES

SEQ ID NO: 694 - protein, 575 aa, Human respirovirus 1
  HN glycoprotein
MAEKGKTNSSYWSTTRNDNSTVNTHINTPAGRTHIWLLIATTMHTVLSFIIMILCIDLIIKQDTCMKTNIMTVSSMNESAKIIKETITELIRQEVISRTINIQSSVQSGIPILLNKQSRDLTQLIEKSCNRQELAQICENTIAIHHADGISPLDPHDFWRCPVGEPLLSNNPNISLLPGPSLLSGSTTISGCVRLPSLSIGDAIYAYSSNLITQGCADIGKSYQVLQLGYISLNSDMYPDLNPVISHTYDINDNRKSCSVIAAGTRGYQLCSLPTVNETTDYSSEGIEDLVFDILDLKGKTKSHRYKNEDITFDHPFSAMYPSVGSGIKIENTLIFLGYGGLTTPLQGDTKCVINRCTNVNQSVCNDALKITWLKKRQVVNVLIRINNYLSDRPKIVVETIPITQNYLGAEGRLLKLGKKIYIYTRSSGWHSNLQIGSLDINNPMTIKWAPHEVLSRPGNQDCNWYNRCPRECISGVYTDAYPLSPDAVNVATTTLYANTSRVNPTIMYSNTSEIINMLRLKNVQLEAAYTTTSCITHFGKGYCFHIVEINQASLNTLQPMLFKTSIPKICKITS

SEQ ID NO: 695 - protein, 240 aa, Human metapneumovirus
  attachment glycoprotein G
MEVRVENIRAIDMFKAKMKNRIRSSKCYRNATLILIGLTALSMALNIFLIIDYATLKNMTKVEHCVNMPPVEPSKKSPMTSAADLNTKLNPQQATQLTTEDSTSLAATSENHLHTETTPTSDATISQQATDEHTTLLRPINRQTTQTTTEKKPTGATTKKDKEKETTTRTTSTAATQTLNTTNQTSNGREATTTSARSRNGATTQNSDQTIQAADPSSKPYHTQTNTTTAHNTDTSSLSS

SEQ ID NO: 696 - protein, 604 aa, Hendra henipavirus
  glycoprotein
MMADSKLVSLNNNLSGKIKDQGKVIKNYYGTMDIKKINDGLLDSKILGAFNTVIALLGSIIIIVMNIMIIQNYTRTTDNQALIKESLQSVQQQIKALTDKIGTEIGPKVSLIDTSSTITIPANIGLLGSKISQSTSSINENVNDKCKFTLPPLKIHECNISCPNPLPFREYRPISQGVSDLVGLPNQICLQKTTSTILKPRLISYTLPINTREGVCITDPLLAVDNGFFAYSHLEKIGSCTRGIAKQRIIGVGEVLDRGDKVPSMFMTNVWTPPNPSTIHHCSSTYHEDFYYTLCAVSHVGDPILNSTSWTESLSLIRLAVRPKSDSGDYNQKYIAITKVERGKYDKVMPYGPSGIKQGDTLYFPAVGFLPRTEFQYNDSNCPIIHCKYSKAENCRLSMGVNSKSHYILRSGLLKYNLSLGGDIILQFIEIADNRLTIGSPSKIYNSLGQPVFYQASYSWDTMIKLGDVDTVDPLRVQWRNNSVISRPGQSQCPRFNVCPEVCWEGTYNDAFLIDRLNWVSAGVYLNSNQTAENPVFAVFKDNEILYQVPLAEDDTNAQKTITDCFLLENVIWCISLVEIYDTGDSVIRPKLFAVKIPAQCSES

SEQ ID NO: 697 - protein, 602 aa, Nipah henipavirus
  attachment glycoprotein
MPAENKKVRFENTTSDKGKIPSKVIKSYYGTMDIKKINEGLLDSKILSAFNTVIALLGSIVIIVMNIMIIQNYTRSTDNQAVIKDALQGIQQQIKGLADKIGTEIGPKVSLIDTSSTITIPANIGLLGSKISQSTASINENVNEKCKFTLPPLKIHECNISCPNPLPFREYRPQTEGVSNLVGLPNNICLQKTSNQILKPKLISYTLPVVGQSGTCITDPLLAMDEGYFAYSHLERIGSCSRGVSKQRIIGVGEVLDRGDEVPSLFMTNVWTPPNPNTVYHCSAVYNNEFYYVLCAVSTVGDPILNSTYWSGSLMMTRLAVKPKSNGGGYNQHQLALRSIEKGRYDKVMPYGPSGIKQGDTLYFPAVGFLVRTEFKYNDSNCPITKCQYSKPENCRLSMGIRPNSHYILRSGLLKYNLSDGENPKVVFIEISDQRLSIGSPSKIYDSLGQPVFYQASFSWDTMIKFGDVLTVNPLVVNWRNNTVISRPGQSQCPRFNTCPEICWEGVYNDAFLIDRINWISAGVFLDSNQTAENPVFTVFKDNEILYRAQLASEDTNAQKTITNCFLLKNKIWCISLVEIYDTGDNVIRPKLFAVKIPEQCT

SEQ ID NO: 698 - protein, 572 aa, Unknown
  Description of Unknown: Swine parainfluenza virus 3 sequence
  hemagglutinin-neuraminidase HN
MEYWKHTNSTKDTNNELGTTRDRHSSKATNIIMYIFWTTTSTILSVIFIMILINLIQENNHNKLMLQEIKKEFAVIDTKIQKTSDDISTSIQSGINTRLLTIQSHVQNYIPLSLTQQMSDLRKFINDLTTKREHQEVPIQRMTHDSGIEPLNPDKFWRCTSGNPSLTSSPKIRLIPGPGLLATSTTVNGCIRIPSLAINNLIYAYTSNLITQGCQDIGKSYQVLQIGIITINSDLVPDLNPRVTHTFNIDDNRKSCSLALLNTDVYQLCSTPKVDERSDYASTGIEDIVLDIVTSNGLIITTRFTNNNITFDKPYAALYPSVGPGIYYKDKVIFLGYGGLEHEENGDVICNTTGCPGKTQRDCNQASYSPWFSNRRMVNSIIVVDKSIDTTFSLRVWTIPMRQNYWGSEGRLLLLGDRIYIYTRSTSWHSKLQLGVIDISDYNNIRINWTWHNVLSRPGNDECPWGHSCPDGCITGVYTDAYPLNPSGSVVSSVILDSQKSRENPIITYSTATNRVNELAIYNRTLPAAYTTTNCITHYDKGYCFHIVEINHRSLNTFQPMLFKTEVPKNCS

SEQ ID NO: 699 - protein, 231 aa, Human metapneumovirus
  attachment glycoprotein G
MEVRVENIRAIDMFKAKIKNRIRSSRCYRNATLILIGLTALSMALNIFLIIDHATLRNMIKTENCANMPSAEPSKKTPMTSTAGPSTKPNPQQATQWTTENSTSPAATLEGHPYTGTTQTPDTTAPQQTTDKHTALPKSTNEQITQTTTEKKTTRATTQKREKRKENTNQTTSTAATQTTNTTNQTRNASETITTSDGPRIDTTTQSSEQTARATEPGSSPYHARRGAGPR

SEQ ID NO: 700 - protein, 595 aa, Feline morbillivirus
  hemagglutinin protein
MKNINIKYYKDSNRYLGKILDEHKIVNSQLYSLSIKVITIIAIIVSLIATIMTIINATSGRTTLNSNTDILLNQRDEIHSIHEMIFDRVYPLITAMSTELGLHIPTLLDELTKAIDQKIKIMNPPVDTVTSDLSWCIKPPNGIIIDPKGYCESMELSKTYKLLLDQLDVSRKKSLTINRKNINQCQLVDDSEIIFATVNIQSTPRFLNFGHTVSNQRITFGQGTYSSTYILTIQEDGITDVQYRVFEIGYISDQFGVFPSLIVSRVLPIRMVLGMESCTLTSDRQGGYFLCMNTLTRSIYDYVNIRDLKSLYITLPHYGKVNYTYFNFGKIRSPHEIDKLWLTSDRGQIISGYFAAFVTITIRNYNNYPYKCLNNPCFDNSENYCRGWYKNITGTDDVPILAYLLVEMYDEEGPLITLVAIPPYNYTAPSHNSLYYDDKINKLIMTTSHIGYIQINEVHEVIVGDNLKAILLNRLSDEHPNLTACRLNQGIKEQYKSDGMIISNSALIDIQERMYITVKAIPPVGNYNFTVELHSRSNTSYILLPKQFNAKYDKLHLECFNWDKSWWCALIPQFSLSWNESLSVDTAIFNLINCK

SEQ ID NO: 701 - protein, 613 aa, Avian metaavulavirus 6
  hemagglutinin-neuraminidase
MASPSELNRSQATLYEGDPNSKRTWRTVYRASTLILDLAILCVSIVAIVRMSTLTPSDVTDSISSSITSLSDTYQSVWSDTHQKVNSIFKEVGISIPVTLDKMQVEMGTAVNIITDAVRQLQGVNGSAGFSITNSPEYSGGIDALIYPQKSLNGKSLAISDLLEHPSFIPAPTTSHGCTRIPTFHLGYRHWCYSHNTIESGCHDAGESIMYLSMGAVGVGHQGKPVFTTSAAVILDDGKNRKSCSVVANPNGCDVLCSLVKQTEDQDYADPTPTPMIHGRLHFNGTYTESMLDQSLFTGHWVAQYPAVGSGSVSHGRLFFPLYGGISKSSSLFPKLRAHAYFTHNEELECKNLTSKQREDLFNAYMPGKIAGSLWAQGIVICNLTTLADCKIAVANTSTMMMAAEGRLQLVQDKVVLYQRSSSWWPVLIYYDILVSELVNARHLDIVNWVPYPQSKFPRPTWTKGLCEKPSICPAVCVTGVYQDVWVVSVGDFSNETVVIGGYLEAASERKDPWIAAANQYNWLTRRQLFTAQTEAAYSSTTCFRNTHQDKVFCLTIMEVTDNLLGDWRIAPLLYEVTVVDRQQSSRKAVAMSEAHRTRFKYYSPENKFTPQH

SEQ ID NO: 702 - protein, 564 aa, Reptilian ferlavirus
  hemagglutinin-neuraminidase protein HN
MDPKSYYCNEDLRSDGGEKSPGGDLYKGIILVSTVISLIIAIISLAFIIDNKINIQSLDPLRGLEDSYLVPIKDKSESISQDIQEGIFPRLNLITAATTTTIPRSIAIQTKDLSDLIMNRCYPSVVNNDTSCDVLAGAIHSNLFSQLDPSTYWTCSSGTPTMNQTVKLLPDNSQIPGSTYSTGCVRIPTFSLGSMIYSYSHNVIYEGCNDHSKSSQYWQLGYISTSKTGEPLQQVSRTLTLNNGLNRKSCSTVAQGRGAYLLCTNVVEDERTDYSTEGIQDLTLDYIDIFGAERSYRYTNNEVDLDRPYAALYPSVGSGTVYNDRILFLGYGGLMTPYGDQAMCQAPECTSATQEGCNSNQLIGYFSGRQIVNCIIEIITVGTEKPIIRVRTIPNSQVWLGAEGRIQTLGGVLYLYIRSSGWHALAQTGIILTLDPIRISWIVNTGYSRPGNGPCSASSRCPAQCITGVYTDIFPLSQNYGYLATVTLLSGVDRVNPVISYGTSTGRVADSQLTSSSQVAAYTTTTCFTFNQKGYCYHIIELSPATLGIFQPVLVVTEIPKICS

SEQ ID NO: 703 - protein, 569 aa, Avian paraavulavirus 4
  hemagglutinin-neuraminidase
MQGNMEGSRDNLTVDDELKTTWRLAYRVVSLLLMVSALIISIVILTRDNSQSIITAINQSSDADSKWQTGIEGKITSIMTDTLDTRNAALLHIPLQLNTLEANLLSALGGNTGIGPGDLEHCRYPVHDTAYLHGVNRLLINQTADYTAEGPLDHVNFIPAPVTTTGCTRIPSFSVSSSIWCYTHNVIETGCNDHSGSNQYISMGVIKRAGNGLPYFSTVVSKYLTDGLNRKSCSVAAGSGHCYLLCSLVSEPEPDDYVSPDPTPMRLGVLTWDGSYTEQAVPERIFKNIWSANYPGVGSGAIVGNKVLFPFYGGVRNGSTPEVMNRGRYYYIQDPNDYCPDPLQDQILRAEQSYYPTRFGRRMVMQGVLACPVSNNSTIASQCQSYYFNNSLGFIGAESRIYYLNGNIYLYQRSSSWWPHPQIYLLDSRIASPGTQNIDSGVNLKMLNVTVITRPSSGFCNSQSRCPNDCLFGVYSDIWPLSLTSDSIFAFTMYLQGKTTRIDPAWALFSNHAIGHEARLFNKEVSAAYSTTTCFSDTIQNQVYCLSILEVRSELLGAFKIVPFLYRVL

SEQ ID NO: 704 - protein, 571 aa, Human orthorubulavirus 2
  hemagglutinin-neuraminidase protein
MEDYSNLSLKSIPKRTCRIIFRTATILGICTLIVLCSSILHEIIHLDVSSGLMDSDDSQQGIIQPIIESLKSLIALANQILYNVAIIIPLKIDSIETVIFSALKDMHTGSMSNTNCTPGNLLLHDAAYINGINKFLVLKSYNGTPKYGPLLNIPSFIPSATSPNGCTRIPSFSLIKTHWCYTHNVMLGDCLDFTTSNQYLAMGIIQQSAAAFPIFRTMKTIYLSDGINRKSCSVTAIPGGCVLYCYVATRSEKEDYATTDLAELRLAFYYYNDTFIERVISLPNTTGQWATINPAVGSGIYHLGFILFPVYGGLISGTPSYNKQSSRYFIPKHPNITCAGNSSEQAAAARSSYVIRYHSNRLIQSAVLICPLSDMHTARCNLVMFNNSQVMMGAEGRLYVIDNNLYYYQRSSSWWSASLFYRINTDFSKGIPPIIEAQWVPSYQVPRPGVMPCNATSFCPANCITGVYADVWPLNDPEPTSQNALNPNYRFAGAFLRNESNRTNPTFYTASASALLNTTGFNNTNHKAAYTSSTCFKNTGTQKIYCLIIIEMGSSLLGEFQIIPFLRELIP

SEQ ID NO: 705 - protein, 565 aa, Mammalian orthorubulavirus 5
  hemagglutinin-neuraminidase protein
MVAEDAPVRATCRVLFRTTTLIFLCTLLALSISILYESLITQKQIMSQAGSTGSNSGLGSITDLLNNILSVANQIIYNSAVALPLQLDTLESTLLTAIKSLQTSDKLEQNCSWSAALINDNRYINGINQFYFSIAEGRNLTLGPLLNMPSFIPTATTPEGCTRIPSFSLTKTHWCYTHNVILNGCQDHVSSNQFVSMGIIEPTSAGFPFFRTLKTLYLSDGVNRKSCSISTVPGGCMMYCFVSTQPERDDYFSAAPPEQRIIIMYYNDTIVERIINPPGVLDVWATLNPGTGSGVYYLGWVLFPIYGGVIKGTSLWNNQANKYFIPQMVAALCSQNQATQVQNAKSSYYSSWFGNRMIQSGILACPLRQDLTNECLVLPFSNDQVLMGAEGRLYMYGDSVYYYQRSNSWWPMTMLYKVTITFTNGQPSAISAQNVPTQQVPRPGTGDCSATNRCPGFCLTGVYADAWLLTNPSSTSTFGSEATFTGSYLNTATQRINPTMYIANNTQIISSQQFGSSGQEAAYGHTTCFRDTGSVMVYCIYIIELSSSLLGQFQIVPFIRQVTLS

SEQ ID NO: 706 - protein, 576 aa, Porcine orthorubulavirus
  attachment protein
MSQLGTDQIMHLAQPAIARRTWRLCFRIFALFILIAIVITQIFMLTFDHTLLTTTQFLTSIGNLQSTITSWTPDVQAMLSISNQLIYTTSITLPLKISTTEMSILTAIRDHCHCPDCSSACPTRQMLLNDPRYMSGVNQFIGAPTESINITFGPLFGIPSFIPTSTTTQGCTRIPSFALGPSHWCYTHNFITAGCADGGHSNQYLAMGTIQSASDGSPLLITARSYYLSDGVNRKSCSIAVVPGGCAMYCYVATRSETDYYAGNSPPQQLLTLVFSNDTIIERTIHPTGLANGWVMLVPGVGSGTLYNEYLLFPAYGGMQQILANQSGEINQFFTPYNATVRCAMAQPQFSQRAAASYYPRYFSNRWIRSAIVACPYRAIYQTQCTLIPLPNRMVMMGSEGRIFTLGDRLFYYQRSSSWWPYPLLYQVGLNFLTTPPSVSSMTQVPLEHLARPGKGGCPGNSHCPATCVTGVYADVWPLTDPRSGVGGTSLVAAGGLDSTSERMAPVNYLAIGESLLSKTYLLSKTQPAAYTTTTCFRDTDTGKIYCITIAELGKVLLGEFQIVPFLREIKIQSRY

SEQ ID NO: 707 - protein, 580 aa, Avian metaavulavirus 2
  hemagglutinin-neuraminidase
MDFPSRENLAAGDISGRKTWRLLFRILTLSIGVVCLAINIATIAKLDHLDNMASNTWTTTEADRVISSITTPLKVPVNQINDMFRIVALDLPLQMTSLQKEITSQVGFLAESINNVLSKNGSAGLVLVNDPEYAGGIAVSLYQGDASAGLNFQPISLIEHPSFVPGPTTAKGCIRIPTFHMGPSHWCYSHNIIASGCQDASHSSMYISLGVLKASQTGSPIFLTTASHLVDDNINRKSCSIVASKYGCDILCSIVIETENEDYRSDPATSMIIGRLFFNGSYTESKINTGSIFSLFSANYPAVGSGIVVGDEAAFPIYGGVKQNTWLFNQLKDFGYFTHNDVYKCNRTDIQQTILDAYRPPKISGRLWVQGILLCPVSLRPDPGCRLKVFNTSNVMMGAEARLIQVGSTVYLYQRSSSWWVVGLTYKLDVSEITSQTGNTLNHVDPIAHTKFPRPSFRRDACARPNICPAVCVSGVYQDIWPISTATNNSNIVWVGQYLEAFYSRKDPRIGIATQYEWKVTNQLFNSNTEGGYSTTTCFRNTKRDKAYCVVISEYADGVFGSYRIVPQLIEIRTTTGKSE

SEQ ID NO: 708 - protein, 236 aa, Human metapneumovirus
  attachment glycoprotein G
MEVKVENIRTIDMLKARVKNRVARSKCFKNASLILIGITTLSIALNIYLIINYTMQENTSESEHHTSSSPMESSRETPTVPIDNSDTNPSSQYPTQQSTEGSTLYFAASASSPETEPTSTPDTTSRPPFVDTHTTPPSASRTKTSPAVHTKNNPRISSRTHSPPWAMTRTVRRTTTLRTSSIRKRSSTASVQPDSSATTHKHEEASPVSPQTSASTTRPQRKSMEASTSTTYNQTS

SEQ ID NO: 709 - protein, 414 aa, Murine orthopneumovirus
  attachment protein
MRPAEQLIQENYKLTSLSMGRNFEVSGSTTNLNFERTQYPDTFRAVVKVNQMCKLIAGVLTSAAVAVCVGVIMYSVFTSNHKANSMQNATIRNSTSAPPQPTAGPPTTEQGTTPKFTKPPTKTTTHHEITEPAKMVTPSEDPYQCSSNGYLDRPDLPEDFKLVLDVICKPPGPEHHSTNCYEKREINLGSVCPDLVTMKANMGLNNGGGEEAAPYIEVITLSTYSNKRAMCVHNGCDQGFCFFLSGLSTDQKRAVLELGGQQAIMELHYDSYWKHYWSNSNCVVPRTNCNLTDQTVILFPSFNNKNQSQCTTCADSAGLDNKFYLTCDGLSRNLPLVGLPSLSPQAHKAALKQSTGTTTAPTPETRNPTPAPRRSKPLSRKKRALCGVDSSREPKPTMPYWCPMLQLFPRRSNS

SEQ ID NO: 710 - protein, 228 aa, Human orthopneumovirus
  truncated attachment glycoprotein
MSKTKDQRAAKTLEKTWDTLNHLLFISSCLYKSNLKSIAQITLSILAMTIPTSLIIVATTFIASANNKVTPTTAIIQDATSQIKNTTPTHLTQNPQPGISFFNLSGTISQTTAILAPTTPSVEPILQSTTVKTKNTTTTQIQPSKLTTKQRQNKPPNKPNDDFHFEVFNFVPCSICSNNPTCWAICKRIPSKKPGKKTTTKPTKKQTIKTTKKDLKPQTTKPKEAPTT

SEQ ID NO: 711 - protein, 577 aa, Avian metaavulavirus 8
  hemagglutinin-neuraminidase protein
MSNIASSLENIVEQDSRKTTWRAIFRWSVLLITTGCLALSIVSIVQIGNLKIPSVGDLADEVVTPLKTTLSDTLRNPINQINDIFRIVALDIPLQVTSIQKDLASQFSMLIDSLNAIKLGNGTNLIIPTSDKEYAGGIGNPVFTVDAGGSIGFKQFSLIEHPSFIAGPTTTRGCTRIPTFHMSESHWCYSHNIIAAGCQDASASSMYISMGVLHVSSSGTPIFLTTASELIDDGVNRKSCSIVATQFGCDILCSIVIEKEGDDYWSDTPTPMRHGRFSFNGSFVETELPVSSMFSSFSANYPAVGSGEIVKDRILFPIYGGIKQTSPEFTELVKYGLFVSTPTTVCQSSWTYDQVKAAYRPDYISGRFWAQVILSCALDAVDLSSCIVKIMNSSTVMMAAEGRIIKIGIDYFYYQRSSSWWPLAFVTKLDPQELADTNSIWLTNSIPIPQSKFPRPSYSENYCTKPAVCPATCVTGVYSDIWPLTSSSSLPSIIWIGQYLDAPVGRTYPRFGIANQSHWYLQEDILPTSTASAYSTTTCFKNTARNRVFCVTIAEFADGLFGEYRITPQLYELVRNN

SEQ ID NO: 712 - protein, 576 aa, Porcine respirovirus 1
  haemagglutinin protein
MEETKVKTSEYWARSPQIHATNHPNVQNREKIKEILTILISFISSLSLVLVIAVLIMQSLHNGTILRCKDVGLESINKSTYSISNAILDVIKQELITRIINTQSSVQVALPILINKKIQDLSLIIEKSSKVHQNSPTCSGVAALTHVEGIKPLDPDDYWRCPSGEPYLEDELTLSLIPGPSMLAGTSTIDGCVRLPSLAIGKSLYAYSSNLITKGCQDIGKSYQVLQLGIITLNSDLHPDLNPIISHTYDINDNRKSCSVAVSETKGYQLCSMPRVNEKTDYTSDGIEDIVFDVLDLKGSSRSFKFSNNDINFDHPFSALYPSVGSGIIWKNELYFLGYGALTTALQGNTKCNLMGCPGATQDNCNKFISSSWLYSKQMVNVLIQVKGYLSSKPSIIVRTIPITENYVGAEGKLVGTRERIYIYTRSTGWHTNLQIGVLNINHPITITWTDHRVLSRPGRSPCAWNNKCPRNCTTGVYTDAYPISPDANYVATVTLLSNSTRNNPTIMYSSSDRVYNMLRLRNTELEAAYTTTSCIVHFDRGYCFHIIEINQKELNTLQPMLFKTAIPKACRISNL

SEQ ID NO: 713 - protein, 579 aa, Human orthorubulavirus 4
  hemagglutinin-neuraminidase protein
MQDSRGNTQIFSQANSMVKRTWRLLFRIVTLILLISIFVLSLIIVLQSTPGNLQSDVDIIRKELDELMENFETTSKSLLSVANQITYDVSVLTPIRQEATETNIIAKIKDHCKDRVVKGESTCTLGHKPLHDVSFLNGFNKFYFTYRDNVQIRLNPLLDYPNFIPTATTPHGCIRIPSFSLSQTHWCYTHNTILRGCEDTASSKQYVSLGTLQTLENGDPYFKVEYSHYLNDRKNRKSCSVVAVLDGCLLYCVIMTKNETENFKDPQLATQLLTYISYNGTIKERIINPPGSSRDWVHISPGVGSGILYSNYIIFPLYGGLMENSMIYNNQSGKYFFPNSTKLPCSNKTSEKITGAKDSYTITYFSKRLIQSAFLICDLRQFLSEDCEILIPSNDHMLVGAEGRLYNIENNIFYYQRGSSWWPYPSLYRIKLNSNKKYPRIIEIKFTKIEIAPRPGNKDCPGNKACPKECITGVYQDIWPLSYPNTAFPHKKRAYYTGFYLNNSLARRNPTFYTADNLDYHQQERLGKFNLTAGYSTTTCFKQTTTARLYCLYILEVGDSVIGDFQIFPFLRSIDQAIT

SEQ ID NO: 714 - protein, 582 aa, Avian metaavulavirus 2
  hemagglutinin-neuraminidase protein
MDALSRENLTEISQGGRRTWRMLFRILTLVLTLVCLAINIATIAKLDSIDTSKVQTWTTTESDRVIGSLTDTLKIPINQVNDMFRIVALDLPLQMTTLQKEIASQVGFLAESINNFLSKNGSAGSVLVNDPEYAGGIGTSLFHGDSASGLDFEAPSLIEHPSFIPGPTTAKGCIRIPTFHMSASHWCYSHNIIASGCQDAGHSSMYISMGVLKATQAGSPSFLTTASQLVDDKLNRKSCSIISTTYGCDILCSLVVENEDADYRSDPPTDMILGRLFFNGTYSESKLNTSAIFQLFSANYPAVGSGIVLGDEIAFPVYGGVKQNTWLFNQLKDYGYFAHNNVYKCNNSNIHQTVLNAYRPPKISGRLWSQVVLICPMRLFINTDCRIKVFNTSTVMMGAEARLIQVGSDIYLYQRSSSWWVVGLTYKLDFQELSSKTGNILNNVSPIAHAKFPRPSYSRDACARPNICPAVCVSGVYQDIWPISTAHNLSQVVWVGQYLEAFYARKDPWIGIATQYDWKKNVRLFNANTEGGYSTTTCFRNTKRDKAFCVIISEYADGVFGSYRIVPQLIEIRTTSKKGLPS

SEQ ID NO: 715 - protein, 610 aa, Avian orthoavulavirus 13
  hemagglutinin-neuraminidase
MQPGISEVSFVNDERSERGTWRLLFRILTIVLCLTSIGIGIPALIYSKEAATSGDIDKSLEAVKTGMSTLSSKIDESINTEQKIYRQVILEAPVSQLNMESNILSAITSLSYQIDGTSNSSGCGSPMHDQDFVGGINKEIWTTDNVNLGEITLTPFLEHLNFIPAPTTGNGCTRIPSFDLGLTHWCYTHNVILSGCQDYSSSFQYIALGVLKISATGHVFLSTMRSINLDDERNRKSCSISATSIGCDIICSLVTEREVDDYNSPAATPMIHGRLDFSGKYNEVDLNVGQLFGDWSANYPGVGGGSFLNGRVWFPIYGGVKEGTPTFKENDGRYAIYTRYNDTCPDSESEQVSRAKSSYRPSYFGGKLVQQAVLSIKIDDTLGLDPVLTISNNSITLMGAESRVLQIEEKLYFYQRGTSWFPSLIMYPLTVDDKMVRFEPPTIFDQFTRPGNHPCSADSRCPNACVTGVYTDGYPIVFHNNHSIAAVYGMQLNDVTNRLNPRSAVWYGVSMSNVIRVSSSTTKAAYTTSTCFKVKKTQRVYCLSIGEIGNTLFGEFRIVPLLLEVYSEKGKSLKSSFDGWEDISINNPLRPLDNHRVDPILISNYTSSWP

SEQ ID NO: 716 - protein, 257 aa, Bovine orthopneumovirus
  attachment glycoprotein
MSNHTHHLKFKTLKRAWKASKYFIVGLSCLYKFNLKSLVQTALTTLAMITLTSLVITAIIYISVGNAKAKPTSKPTIQQTQQPQNHTSPFFTEHNYKSTHTSIQSTTLSQLPNTDTTRETTYSHSINETQNRKIKSQSTLPATRKPPINPSGSNPPENHQDHNNSQTLPYVPCSTCEGNLACLSLCQIGPERAPSRAPTITLKKTPKPKTTKKPTKTTIHHRTSPEAKLQPKNNTAAPQQGILSSPEHHTNQSTTQI

SEQ ID NO: 717 - protein, 595 aa, Menangle pararubulavirus
  attachment protein
MWNSIPQLVSDHEEAKGKFTDIPLQDDTDSQHPSGSKSTCRTLFRTVSIILSLVILVLGVTSTMFSAKYSGGCATNSQLLGVSNLINQIQKSIDSLISEVNQVSITTAVTLPIKIMDFGKSVTDQVTQMIRQCNTVCKGPGQKPGSQNVRIMPSNNLSTFQNINMSARGIAYQDVPLTFVRPIKNPQSCSRFPSYSVSFGVHCFANAVTDQTCELNQNTFYRVVLSVSKGNISDPSSLETKAETRTPKGTPVRTCSIISSVYGCYLLCSKATVPESEEMKTIGFSQMFILYLSMDSKRIIYDNIVSSTSAIWSGLYPGEGAGIWHMGQLFFPLWGGIPFLTPLGQKILNSTLDIPEVGSKCKSDLTSNPAKTKDMLFSPYYGENVMVFGFLTCYLLSNVPTNCHADYLNSTVLGFGSKAQFYDYRGIVYMYIQSAGWYPFTQIFRITLQLKQNRLQAKSIKRIEVTSTTRPGNRECSVLRNCPYICATGLFQVPWIVNSDAITSKEVDNMVFVQAWAADFTEFRKGILSLCSQVSCPINDLLSKDNSYMRDTTTYCFPQTVPNILSCTSFVEWGGDSGNPINILEIHYEVIFVAS

SEQ ID NO: 718 - protein, 574 aa, Avian metaavulavirus 5
  hemagglutinin neuraminidase protein
MDKSYYTEPEDQRGNSRTWRLLFRLIVLTLLCLIACTSVSQLFYPWLPQVLSTLISLNSSIITSSNGLKKEILNQNIKEDLIYREVAINIPLTLDRVTVEVGTAVNQITDALRQLQSVNGSAAFALSNSPDYSGGIEHLVFQRNTLINRSVSVSDLIEHPSFIPTPTTQHGCTRIPTFHLGTRHWCYSHNIIGQGCADSGASMMYISMGALGVSSLGTPTFTTSATSILSDSLNRKSCSIVATTEGCDVLCSIVTQTEDQDYADHTPTPMIHGRLWFNGTYTERSLSQSLFLGTWAAQYPAVGSGIMTPGRVIFPFYGGVIPNSPLFLDLERFALFTHNGDLECRNLTQYQKEAIYSAYKPPKIRGSLWAQGFIVCSVGDMGNCSLKVINTSTVMMGAEGRLQLVGDSVMYYQRSSSWWPVGILYRLSLVDIIARDIQVVINSEPLPLSKFPRPTWTPGVCQKPNVCPAVCVTGVYQDLWAISAGETLSEMTFFGGYLEASTQRKDPWIGVANQYSWFMRRRLFKTSTEAAYSSSTCFRNTRLDRNFCLLIFELTDNLLGDWRIVPLLFELTIV

SEQ ID NO: 719 - protein, 622 aa, Cedar henipavirus
  attachment glycoprotein
MLSQLQKNYLDNSNQQGDKMNNPDKKLSVNFNPLELDKGQKDLNKSYYVKNKNYNVSNLLNESLHDIKFCIYCIFSLLIIITIINIITISIVITRLKVHEENNGMESPNLQSIQDSLSSLTNMINTEITPRIGILVTATSVTLSSSINYVGTKTNQLVNELKDYITKSCGFKVPELKLHECNISCADPKISKSAMYSTNAYAELAGPPKIFCKSVSKDPDFRLKQIDYVIPVQQDRSICMNNPLLDISDGFFTYIHYEGINSCKKSDSFKVLLSHGEIVDRGDYRPSLYLLSSHYHPYSMQVINCVPVTCNQSSFVFCHISNNTKTLDNSDYSSDEYYITYFNGIDRPKTKKIPINNMTADNRYIHFTFSGGGGVCLGEEFIIPVTTVINTDVFTHDYCESFNCSVQTGKSLKEICSESLRSPTNSSRYNLNGIMIISQNNMTDFKIQLNGITYNKLSFGSPGRLSKTLGQVLYYQSSMSWDTYLKAGFVEKWKPFTPNWMNNTVISRPNQGNCPRYHKCPEICYGGTYNDIAPLDLGKDMYVSVILDSDQLAENPEITVFNSTTILYKERVSKDELNTRSTTTSCFLFLDEPWCISVLETNRFNGKSIRPEIYSYKIPKYC

SEQ ID NO: 720 - protein, 595 aa, Teviot pararubulavirus
  attachment protein
MWSTQASKHPAMVNSATNLVDIPLDHPSSAQFPINRKRTGRLIYRLFSILCNLILISILISLVVIWSRSSRDCAKSDGLSSVDNQLSSLSRSINSLITEVNQISVTTAINLPIKLSEFGKSVVDQVTQMIRQCNAACKGPGEKPGIQNVRINIPNNFSTYSELNRTANSLNFQSRTALFARPNPYPKTCSRFPSYSVYFGIHCFSHAVTDSSCELSDSTYYRLVIGVADKNLSDPADVKYIGETTTPVRVQTRGCSVVSSIYGCYLLCSKSNQDYQDDFREQGFHQMFILFLSRELKTTFFDDMVSSTTVTWNGLYPGEGSGIWHMGHLVFPLWGGIRFGTHASEGILNSTLELPPVGPSCKRSLADNGLINKDVLFSPYFGDSVMVFAYLSCYMLSNVPTHCQVETMNSSVLGFGSRAQFYDLKGIVYLYIQSAGWFSYTQLFRLSLQSKGYKLSVKQIKRIPISSTSRPGTEPCDIIHNCPYTCATGLFQAPWIVNGDSIRDRDVRNMAFVQAWSGAINTFQRPFMSICSQYSCPLSELLDSESSIMRSTTTYCFPSLTESILQCVSFIEWGGPVGNPISINEVYSSISFRPD

SEQ ID NO: 721 - protein, 632 aa, Mossman narmovirus
  attachment glycoprotein
MVDPPAVSYYTGTGRNDRVKVVTTQSTNPYWAHNPNQGLRRLIDMVVNVIMVTGVIFALINIILGIVIISQSAGSRQDTSKSLDIIQHVDSSVAITKQIVMENLEPKIRSILDSVSFQIPKLLSSLLGPGKTDPPIALPTKASTPVIPTEYPSLNTTTCLRIEESVTQNAAALFNISFDLKTVMYELVTRTGGCVTLPSYSELYTRVRTFSTAIRNPKTCQRAGQETDLNLIPAFIGTDTGILINSCVRQPVIATGDGIYALTYLTMRGTCQDHRHAVRHFEIGLVRRDAWWDPVLTPIHHFTEPGTPVFDGCSLTVQNQTALALCTLTTDGPETDIHNGASLGLALVHFNIRGEFSKHKVDPRNIDTQNQGLHLVTTAGKSAVKKGILYSFGYMVTRSPEPGDSKCVTEECNQNNQEKCNAYSKTTLDPDKPRSMIIFQIDVGAEYFTVDKVVVVPRTQYYQLTSGDLFYTGEENDLLYQLHNKGWYNKPIRGRVTFDGQVTLHEHSRTYDSLSNQRACNPRLGCPSTCELTSMASYFPLDKDFKAAVGVIALRNGMTPIITYSTDDWRNHWKYIKNADLEFSESSLSCYSPNPPLDDYVLCTAVITAKVMSNTNPQLLATSWYQYDKCHT

SEQ ID NO: 722 - protein, 709 aa, Jun jeilongvirus
  attachment glycoprotein
MNPVAMSNFYGINQADHLREKGDQPEKGPSVLTYVSLITGLLSLFTIIALNVTNIIYLTGSGGTMATIKDNQQSMSGSMRDISGMLVEDLKPKTDLINSMVSYTIPSQISAMSAMIKNEVLRQCTPSFMFNNTICPIAEHPVHTSYFEEVGIEAISMCTGTNRKLVVNQGINFVEYPSFIPGSTKPGGCVRLPSFSLGLEVFAYAHAITQDDCTSSSTPDYYFSVGRIADHGTDVPVFETLAEWFLDDKMNRRSCSVTAAGKGGWLGCSILVGSFTDELTSPEVNRISLSYMDTFGKKKDWLYTGSEVRADQSWSALFFSVGSGVVIGDTVYFLVWGGLNHPINVDAMCRAPGCQSPTQSLCNYAIKPQEWGGNQIVNGILHFKHDTNEKPTLHVRTLSPDNNWMGAEGRLFHFHNSGKTFIYTRSSTWHTLPQVGILTLGWPLSVQWVDITSISRPGQSPCEYDNRCPHQCVTGVYTDLFPLGVSYEYSVTAYLDQVQSRMNPKIALVGAQEKIYEKTITTNTQHADYTTTSCFAYKLRVWCVSIVEMSPGVITTRQPVPFLYHLNLGCQDTSTGSLTPLDAHGGTYLNTDPVGNKVDCYFVLHEGQIYFGMSVGPINYTYSIVGRSREIGANMNVSLNQLCHSVYTEFLKEKEHPGTRNNIDVEGWLLKRIETLNGTKIFGLDDLEGSGPGHQSGPEDPSIAPIGHN

SEQ ID NO: 723 - protein, 264 aa, Avian metapneumovirus
  attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTAGASPRAS

SEQ ID NO: 724 - protein, 391 aa, Avian metapneumovirus
  attachment protein
MGSKLYMVQGTSAYQTAVGFWLDIGRRYILAIVLSAFGLTCTVTIALTVSVIVEQSVLEECRNYNGGDRDWWSTTQEQPTTAPSATPAGNYGGLQTARTRKSESCLHVQISYGDMYSRSDTVLGGFDCMGLLVLCKSGPICQRDNQVDPTALCHCRVDLSSVDCCKVNKISTNSSTTSEPQKTNPAWPSQDNTDSDPNPQGITTSTATLLSTSLGLMLTSKTGTHKSGPPQALPGSNTNGKTTTDRELGSTNQPNSTTNGQHNKHTQRMTLPPSYDNTRTILQHTTPWEKTFSTYKPTHSPTNESDQSLPTTQNSINCEHFDPQGKEKICYRVGSYNSNITKQCRIDVPLCSTYNTVCMKTYYTEPFNCWRRIWRCLCDDGVGLVEWCCTS

SEQ ID NO: 725 - protein, 1052 aa, Tailam jeilongvirus
  attachment glycoprotein
MSQLAAHNLAMSNFYGIHQGGQSTSQKEEEQPVQGVIRYASMIVGLLSLFTIIALNVTNIIYMTESGGTMQSIKNAQGSIDGSMKDLSGTIMEDIKPKTDLINSMVSYNIPAQLSMIHQIIKNDVLKQCTPSFMFNNTICPLAENPTHSRYFEEVNLDSISECSGNEMSLELGTEPEFIEYPSFAPGSTKPGSCVRLPSFSLSSTVFAYTHTIMGHGCSELDVGDHYLAIGRIADAGHEIPQFETISSWFINDKINRRSCTVAAGVMETWMGCVIMTETFYDDLDSLDTGKITISYLDVFGRKKEWIYTRSEILYDYTYTSVYFSIGSGVVVGDTVYFLLWGSLSSPIEETAYCYAPGCSNYNQRMCNEAQRPAKFGHRQMANAILRFKTNSMGKPSISVRTLSPTVIPFGTEGRLIYSDFTKIIYLYLRSTSWYVLPLTGLLILGPPVSISWVTQEAVSRPGEYPCGASNRCPKDCITGVYTDLFPLGARYEYAVTVYLNAETYRVNPTLALIDRSKIIARKKITTESQKAGYTTTTCFVFKLRIWCMSVVELAPATMTAFEPVPFLYQLDLTCKRNNGTTAMQFSGQDGMYKSGRYKSPRNECFFEKVSNKYYFVVSTPEGIQPYEVRDLTPERVSHVIMYISDVCAPALSAFKKLIPAMRPITTLTIGNWQFRPVDISGGLRVNIYRNLTRYGDLSMSAPEDPGTDTFPGTHAPSKGHEEVGHYTLPNEKLSEVTTAAVKTKESLNLIPDTKDTRGEEENGSGLNEIITGHTTPGHIKTHPAETKVTKHTVIIPQIEEDGSGATTSTELQDETGYHTEDYNTTNTNGSLTAPNERNNYTSGDHTVSGEDITHTITVSDRTKTTQTLPTDNTFNQTPTKIQEGSPKSESTPKDYTAIESEDSHFTDPTLIRSTPEGTIVQVIGDQFHSAVTQLGESNAIGNSEPIDQGNNLIPTTDRGTMDNTSSQSHSSTTSTQGSHSAGHGSQSNMNLTALADTDSVTDQSTSTQEIDHEHENVSSILNPLSRHTRVMRDTVQEALTGAWGFIRGMIP

SEQ ID NO: 726 - protein, 242 aa, Human metapneumovirus
  attachment glycoprotein G
MEVRVENIRAIDMFKAKIKNRIRNSRCYRNATLILIGLTALSMALNIFLIIDHATLRNMIKTENCANMPSAEPSKKTPMTSIAGPSTKPNPQQATQWTTENSTSPAATLEGHPYTGTTQTPDTTAPQQTTDKHTALPKSTNEQITQTTTEKKTTRATTQKRKKEKKTQTKPQVQLQPKQPTPPTKSEMQVRQSQHPTDPELTPLPKAVNRQPGQQNQAPHHIMHGEVQDPGERNTQVSHPSS

SEQ ID NO: 727 - protein, 585 aa, Avian metapneumovirus
  attachment glycoprotein
MEVKIENVGKSQELRVKVKNFIKRSDCKKKLFALILGLISFDITMNIMLSVMYVESNEALSSCRVQGTPAPRDNRTNTENTAKETTLHTMTTTRNTEAGGTKTTKPQADERATSPSKNPTIGADKHKTTRATTEAEQEKQSKQTTEPGTSTPKHIPARPSSKSPATTKTTTQPTTPTVAKGGTAPKNRQTTTKKTEADTPTTSRAKQTNKPTGTETTPPRATTETDKDKEGPTQHTTKEQPETTAGGTTTPQPRRTTSRPAPTTNTKEGAETTGTRTTKSTQTSASPPRPTRSTPSKTATGTNKRATTTKGPNTASTDRRQQTRTTPKQDQQTQTKAKTTTNKAHAKAATTPEHNTDTTDSMKENSKEDKTTRDPSSKATTKQENTSKGTTATNLGNNTEAGARTPPTTTPTRHTTEPATSTAGGHTKARTTRWKSTAARQPTRNNTTADTKTAQSKQTTPAQLGNNTTPENTTPPDNKSNSQTNVAPTEEIEIGSSLWRRRYVYGPCRENALEHPMNPCLKDNTTWIYLDNGRNLPAGYYDSKTDKIICYGIYRGNSYCYGRIECTCKNGTGLLSYCCNSYNWS

SEQ ID NO: 728 - protein, 609 aa, Rinderpest morbillivirus
  H protein
MSSPRDRVNAFYKDNLQFKNTRVVLNKEQLLIERPYMLLAVLFVMFLSLVGLLAIAGIRLHRAAVNTAEINSGLTTSIDITKSIEYQVKDVLTPLFKIIGDEVGLRTPQRFTDLTKFISDKIKFLNPDKEYDFRDINWCISPPERIKINYDQYCAHTAAEELITMLVNSSLAGTAVLRTSLVNLGRSCTGSTTTKGQFSNMSLALSGIYSGRGYNISSMITITEKGMYGSTYLVGKHNQGARRPSTAWQRDYRVFEVGIIRELGVGTPVFHMTNYLELPRQPELEICMLALGEFKLAALCLADNSVALHYGGLRDDHKIRFVKLGVWPSPADSDTLATLSAVDPTLDGLYITTHRGIIAAGKAVWAVPVTRTDDQRKMGQCRREACREKPPPFCNSTDWEPLEAGRIPAYGILTIRLGLADKPEIDIISEFGPLITHDSGMDLYTPLDGNEYWLTIPPLQNSALGTVNTLVLEPSLKISPNILTLPIRSGGGDCYTPTYLSDLADDDVKLSSNLVILPSRNLQYVSATYDTSRVEHAIVYYIYSTGRLSSYYYPVKLPIKGDPVSLQIGCFPWGLKLWCHHFCSVIDSGTGKQVTHTGAVGIEITCNSR

SEQ ID NO: 729 - protein, 575 aa, Avian metaavulavirus 10
  hemagglutinin-neuraminidase
MDSSQMNILDAMDRESSKRTWRGVFRVTTIIMVVTCVVLSAITLSKVAHPQGFDTNELGNGIVDRVSDKITEALTVPNNQIGEIFKIVALDLHVLVSSSQQAIAGQIGMLAESINSILSQNGSASTILSSSPEYAGGIGVPLFSNKLTNGTVIKPITLIEHPSFIPGPTTIGGCTRIPTFHMASSHWCYSHNIIEKGCKDSGISSMYISLGVLQVLKKGTPVFLVTASAVLSDDRNRKSCSIISSRFGCEILCSLVTEAESDDYKSDTPTGMVHGRLYFNGTYREGLVDTETIFRDFSANYPGVGSGEIVEGHIHFPIYGGVKQNTGLYNSLTPYWLDAKNKYDYCKLPYTNQTIQNSYKPPFIHGRFWAQGILSCELDLFNLGNCNLKIIRSDKVMMGAESRLMLVGSKLLMYQRASSWWPLGITQEIDIAELHSSNTTILREVKPILSSKFPRPSYQPNYCTKPSVCPAVCVTGVYTDMWPISITGNISDYAWISHYLDAPTSRQQPRIGIANQYFWIHQTTIFPTNTQSSYSTTTCFRNQVRSRMFCLSIAEFADGVFGEFRIVPLLYELRV

SEQ ID NO: 730 - protein, 593 aa, Tioman pararubulavirus
  attachment protein
MWATSESKAPIPANSTLNLVDVPLDEPQTITKHRKQKRTGRLVFRLLSLVLSLMTVILVLVILASWSQKINACATKEGFNSLDLQISGLVKSINSLITEVNQISITTAINLPIKLSDFGKSIVDQVTQMIRQCNAVCKGPGEKPGIQNIRINIPNNFSTYLELNNTVKSIELQRRPALLARPNPIPKSCSRFPSYSVNFGIHCFAHAITDQSCELSDKTYYRLAIGISDKNLSDPSDVKYIGEAFTPMGLQARGCSVISSIYGCYLLCSKSNQGYEADFQTQGFHQMYILFLSRDLKTTLFNDMISSTTVVWNGLYPGEGAGIWHMGYLIFPLWGGIKIGTPASTSILNSTLDLPLVGPSCKSTLEENNLINKDVLFSPYFGESVMVFGFLSCYMLSNVPTHCQVEVLNSSVLGFGSRSQLMDLKGIVYLYIQSAGWYSYTQLFRLSLQSRGYKLTVKQIRRIPISSTTRPGTAPCDVVHNCPYTCATGLFQAPWIVNGDSILDRDVRNLVFVQAWSGNFNTFQKGLISICNQYTCPLTTLLDNDNSIMRSTTTYCYPSLSEYNLQCQSFIEWGGPVGNPIGILEVHYIIKFK

SEQ ID NO: 731 - protein, 604 aa, Cetacean morbillivirus
  haemagglutinin protein
MSSPRDKVDAFYKDIPRPRNNRVLLDNERVIIERPLILVGVLAVMFLSLVGLLAIAGVRLQKATTNSIEVNRKLSTNLETTVSIEHHVKDVLTPLFKIIGDEVGLRMPQKLTEIMQFISNKIKFLNPDREYDFNDLHWCVNPPDQVKIDYAQYCNHIAAEELIVTKFKELMNHSLDMSKGRIFPPKNCSGSVITRGQTIKPGLTLVNIYTTRNFEVSFMVTVISGGMYGKTYFLKPPEPDDPFEFQAFRIFEVGLVRDVGSREPVLQMTNFMVIDEDEGLNFCLLSVGELRLAAVCVRGRPVVTKDIGGYKDEPFKVVTLGIIGGGLSNQKTEIYPTIDSSIEKLYITSHRGIIRNSKARWSVPAIRSDDKDKMEKCTQALCKSRPPPSCNSSDWEPLTSNRIPAYAYIALEIKEDSGLELDITSNYGPLIIHGAGMDIYEGPSSNQDWLAIPPLSQSVLGVINKVDFTAGFDIKPHTLTTAVDYESGKCYVPVELSGAKDQDLKLESNLVVLPTKDFGYVTATYDTSRSEHAIVYYVYDTARSSSYFFPFRIKARGEPIYLRIECFPWSRQLWCHHYCMINSTVSNEIVVVDNLVSINMSCSR

SEQ ID NO: 732 - protein, 734 aa, Beilong jeilongvirus
  attachment glycoprotein
MSQLAAHNLAMSNFYGTHQGDLSGSQKGEEQQVQGVIRYVSMIVSLLSLFTIIALNVTNIIYMTESGGTMQSIKTAQGSIDGSMREISGVIMEDVKPKTDLINSMVSYNIPAQLSMIHQIIKNDVPKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDRNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFAGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVNIGRNLTKEGDLTMSAPEDPGSNTFPGNHIPGNGILDAGYYTVEYPKE

SEQ ID NO: 733 - protein, 582 aa, Mapuera orthorubulavirus
  attachment protein
MASLQSEPGSQKPHYQSDDQLVKRTWRSFFRFSVLVVTITSLALSIITLIGVNRISTAKQISNAFAAIQANILSSIPDIRPINSLLNQLVYTSSVTLPLRISSLESNVLAAIQEACTYRDSQSSCSATMSVMNDQRYIEGIQVYSGSFLDLQKHTLSPPIAFPSFIPTSTTTVGCTRIPSFSLTKTHWCYTHNYIKTGCRDATQSNQYIALGTIYTDPDGTPGFSTSRSQYLNDGVNRKSCSISAVPMGCALYCFISVKEEVDYYKGTVPPAQTLILFFFNGTVHEHRIVPSSMNSEWVMLSPGVGSGVFYNNYIIFPLYGGMTKDKAEKRGELTRFFTPKNSRSLCKMNDSVFSNAAQSAYYPPYFSSRWIRSGLLACNWNQIITTNCEILTFSNQVMMMGAEGRLILINDDLFYYQRSTSWWPRPLVYKLDIELNYPDSHIQRVDQVEVTFPTRPGWGGCVGNNFCPMICVSGVYQDVWPVTNPVNTTDSRTLWVGGTLLSNTTRENPASVVTSGGSISQTVSWFNQTVPGAYSTTTCFNDQVQGRIFCLIIFEVGGGLLGEYQIVPFLKELKYQGAVHA

SEQ ID NO: 734 - protein, 657 aa, Nariva narmovirus
  attachment protein
MAPINYPASYYTNNAERPVVITTKSTESKGQRPLPLGNARFWEYFGHVCGTLTFCMSLIGIIVGIIALANYSSDKDWKGRIGGDIQVTRMATEKTVKLILEDTTPKLRNILDSVLFQLPKMLASIASKINTQTPPPPTTSGHSTALATQCSSNCENRPEIGYDYLRQVEQSLQRITNISIQLLEASEIHSMAGAYPNALYKIRTQDSWSVTAKECPLQAFQPNLNLIPAMIGTATGALIRNCVRQPVIVVDDGVYMLTYLAMRGSCQDHQKSVRHFEMGVITSDPFGDPVPTPLRHWTKRALPAYDGCALAVKGHAGFALCTETSVGPLRDRTAKRKPNIVLFKASLVGELSERVIPPQSWLSGFSFFSVYTVAGKGYAYHSKFHAFGNVVRVGQSEYQAKCRGTGCPTANQDDCNTAQRVSQEDNTYLHQAILSVDIDSVIDPEDVVYVIERDQYYQASAGDLYRVPETGEILYNLHNGGWSNEVQVGRIQPSDRFYMREIQLTSTRVPAPNGCNRVKGCPGGCVAVISPAFTPMHPEFNVGVGIFPMNQPHNPSIMHVQQQTELFWKPIVGGNITLHESSIACYSTVPPNPSYDLCIGVMTLLLHQGQLPQFQALSWYQPTMCNGNAPQNRRALIPVIVEDSKAMSVSSDAPRTP

SEQ ID NO: 735 - protein, 632 aa, Ghanaian bat henipavirus
  glycoprotein
MPQKTVEFINMNSPLERGVSTLSDKKTLNQSKITKQGYFGLGSHSERNWKKQKNQNDHYMTVSTMILEILVVLGIMFNLIVLTMVYYQNDNINQRMAELTSNITVLNLNLNQLTNKIQREIIPRITLIDTATTITIPSAITYILATLTTRISELLPSINQKCEFKTPTLVLNDCRINCTPPLNPSDGVKMSSLATNLVAHGPSPCRNFSSVPTIYYYRIPGLYNRTALDERCILNPRLTISSTKFAYVHSEYDKNCTRGFKYYELMTFGEILEGPEKEPRMFSRSFYSPTNAVNYHSCTPIVTVNEGYFLCLECTSSDPLYKANLSNSTFHLVILRHNKDEKIVSMPSFNLSTDQEYVQIIPAEGGGTAESGNLYFPCIGRLLHKRVTHPLCKKSNCSRTDDESCLKSYYNQGSPQHQVVNCLIRIRNAQRDNPTWDVITVDLTNTYPGSRSRIFGSFSKPMLYQSSVSWHTLLQVAEITDLDKYQLDWLDTPYISRPGGSECPFGNYCPTVCWEGTYNDVYSLTPNNDLFVTVYLKSEQVAENPYFAIFSRDQILKEFPLDAWISSARTTTISCFMFNNEIWCIAALEITRLNDDIIRPIYYSFWLPTDCRTPYPHTGKMTRVPLRSTYNY

SEQ ID NO: 736 - protein, 569 aa, Avian metaavulavirus 7
  hemagglutinin-neuraminidase
MESIGKGTWRTVYRVLTILLDVVIIILSVIALISLGLKPGERIINEVNGSIHNQLVPLSGITSDIQAKVSSIYRSNLLSIPLQLDQINQAISSSARQIADTINSFLALNGSGTFIYTNSPEFANGFNRAMFPTLNQSLNMLTPGNLIEFTNFIPTPTTKSGCIRIPSFSMSSSHWCYTHNIIASGCQDHSTSSEYISMGVVEVTDQAYPNFRTTLSITLADNLNRKSCSIAATGFGCDILCSVVTETENDDYQSPEPTQMIYGRLFFNGTYSEMSLNVNQMFADWVANYPAVGSGVELADFVIFPLYGGVKITSTLGASLSQYYYIPKVPTVNCSETDAQQIEKAKASYSPPKVAPNIWAQAVVRCNKSVNLANSCEILTFNTSTMMMGAEGRLLMIGKNVYFYQRSSSYWPVGIIYKLDLQELTTFSSNQLLSTIPIPFEKFPRPASTAGVCSKPNVCPAVCQTGVYQDLWVLYDLGKLENTTAVGLYLNSAVGRMNPFIGIANTLSWYNTTRLFAQGTPASYSTTTCFKNTKIDTAYCLSILELSDSLLGSWRITPLLYNITLSIMS

SEQ ID NO: 737 - protein, 588 aa, Tuhoko pararubulavirus 2
  hemagglutinin-neuraminidase
MPPVPTVSQSIDEGSFTDIPLSPDDIKHPLSKKTCRKLFRIVTLIGVGLISILTIISLAQQTGILRKVDSSDFQSYVQESFKQVLNLMKQFSSNLNSLIEITSVTLPFRIDQFGTDIKTQVAQLVRQCNAVCRGPIKGPTTQNIVYPALYETSLNKTLETKNVRIQEVRQEVDPVPGPGLSNGCTRNPSFSVYHGVWCYTHATSIGNCNGSLGTSQLFRIGNVLEGDGGAPYHKSLATHLLTTRNVSRQCSATASYYGCYFICSEPVLTERDDYETPGIEPITIFRLDPDGNWVVFPNINRFTEYSLKALYPGIGSGVLFQGKLIFPMYGGIDKERLSALGLGNIGLIERRMADTCNHTEKELGRSFPGAFSSPYYHDAVMLNFLLICEMIENLPGDCDLQILNPTNMSMGSESQLSVLDNELFLYQRSASWWPYTLIYRLNMRYTGKYLKPKSIIPMVIKSNTRPGYEGCNHERVCPKVCVTGVFQAPWILSIGRDHKERVSNVTYMVAWSMDKSDRTYPAVSVCGSDTCKLTVPLGDSKVHSAYSVTRCYLSRDHMSAYCLVIFELDARPWAEMRIQSFLYKLILT

SEQ ID NO: 738 - protein, 582 aa, Tuhoko pararubulavirus 3
  hemagglutinin-neuraminidase
MHNRTQSVSSIDTSSDVYLPRRKKAVTKFTFKKIFRVLILTLLLSIIIIIAVIFPKIDHIRETCDNSQILETITNQNSEIKNLINSAITNLNVLLTSTTVDLPIKLNNFGKSIVDQVTMMVRQCNAVCRGPGDRPTQNIELFKGLYHTSPPSNTSTKLSMITEASNPDDIVPRPGKLLGCTRFPSFSVHYGLWCYGHMASTGNCSGSSPSVQIIRIGSIGTNKDGTPKYVIIASASLPETTRLYHCSVTMTSIGCYILCTTPSVSETDDYSTMGIEKMSISFLSLDGYLTQLGQPTGLDNQNLYALYPGPGSGVIFRDFLIFPMMGGIRLMDAQKMLNRNITYRGFPPSETCTESELKLKQEVANMLTSPYYGEVLVLNFLYVCSLLDNIPGDCSVQLIPPDNMTLGAESRLYVLNGSLIMYKRGSSWWPYTELYQINYRVNNRAFRVRESVRINTTSTSRPGVQGCNLEKVCPKVCVSGIYQSPGIISAPVNPTRQEEGLLYFLVWTSSMSSRTGPLSSLCDHSTCRITYPIGDDTIFIGYTDSSCFMSSIKEGIYCIAFLELDNQPYSMMAIRSLSYIIN

SEQ ID NO: 739 - protein, 625 aa, Mojiang henipavirus
  attachment glycoprotein
MATNRDNTITSAEVSQEDKVKKYYGVETAEKVADSISGNKVFILMNTLLILTGAIITITLNITNLTAAKSQQNMLKIIQDDVNAKLEMFVNLDQLVKGEIKPKVSLINTAVSVSIPGQISNLQTKFLQKYVYLEESITKQCTCNPLSGIFPTSGPTYPPTDKPDDDTTDDDKVDTTIKPIEYPKPDGCNRTGDHFTMEPGANFYTVPNLGPASSNSDECYTNPSFSIGSSIYMFSQEIRKTDCTAGEILSIQIVLGRIVDKGQQGPQASPLLVWAVPNPKIINSCAVAAGDEMGWVLCSVTLTAASGEPIPHMFDGFWLYKLEPDTEVVSYRITGYAYLLDKQYDSVFIGKGGGIQKGNDLYFQMYGLSRNRQSFKALCEHGSCLGTGGGGYQVLCDRAVMSFGSEESLITNAYLKVNDLASGKPVIIGQTFPPSDSYKGSNGRMYTIGDKYGLYLAPSSWNRYLRFGITPDISVRSTTWLKSQDPIMKILSTCTNTDRDMCPEICNTRGYQDIFPLSEDSEYYTYIGITPNNGGTKNFVAVRDSDGHIASIDILQNYYSITSATISCFMYKDEIWCIAITEGKKQKDNPQRIYAHSYKIRQMCYNMKSATVTVGNAKNITIRRY

SEQ ID NO: 740 - protein, 614 aa, Avian orthoavulavirus 12
  hemagglutinin-neuraminidase
MESATSQVSFENDKTSDRRTWRAVFRVLMIILALSSLCVTVAALIYSAKAAIPGNIDASEQRILSSVEAVQVPVSRLEDTSQKIYRQVILEAPVTQLNMETNILNAITSLSYQIDASANSSGCGAPVHDSDFTGGVGRELLQEAEVNLTIIRPSKFLEHLNFIPAPTTGNGCTRIPSFDLGQTHWCYTHNVVLNGCRDRGHSFQYVALGILRTSATGSVFLSTLRSVNLDDDRNRKSCSVSATPIGCEMLCSLVTETEEGDYDSIDPTPMVHGRLGFDGKYREVDLSEKEIFADWRANYPAVGGGAFFGNRVWFPVYGGLKEGTQSERDAEKGYAIYKRFNNTCPDDNTTQIANAKASYRPSRFGGRFIQQGILSFKVEGNLGSDPILSLTDNSITLMGAEARVMNIENKLYLYQRGTSWFPSALVYPLDVANTAVKVRAPYIFDKFTRPGGHPCSASSRCPNVCVTGVYTDAYPLVFSRSHDIVAVYGMQLAAGTARLDPQAAIWYGNEMSTPTKVSSSTTKAAYTTSTCFKVTKTKRIYCISIAEIGNTLFGEFRIVPLLIEVQKTPLTRRSELRQQMPQPPIDLVIDNPFCAPSGNLSRKNAIDEYANSWP

SEQ ID NO: 741 - protein, 577 aa, Avian paraavulavirus 3
  hemagglutinin
MEPTGSKVDIVPSQGTKRTCRTFYRLLILILNLIIIILTIISIYVSISTDQHKLCNNEADSLLHSIVEPITVPLGTDSDVEDELREIRRDTGINIPIQIDNTENIILTTLASINSNIARLHNATDESPTCLSPVNDPRFIAGINKITKGSMIYRNFSNLIEHVNFIPSPTTLSGCTRIPSFSLSKTHWCYSHNVISTGCQDHAASSQYISIGIVDTGLNNEPYLRTMSSRLLNDGLNRKSCSVTAGAGVCWLLCSVVTESESADYRSRAPTAMILGRFNFYGDYTESPVPASLFSGRFTANYPGVGSGTQLNGTLYFPIYGGVVNDSDIELSNRGKSFRPRNPTNPCPDPEVTQSQRAQASYYPTRFGRLLIQQAILACRISDTTCTDYYLLYFDNNQVMMGAEARIYYLNNQMYLYQRSSSWWPHPLFYRFSLPHCEPMSVCMITDTHLILTYATSRPGTSICTGASRCPNNCVDGVYTDVWPLTEGTTQDPDSYYTVFLNSPNRRISPTISIYSYNQKISSRLAVGSEIGAAYTTSTCFSRTDTGALYCITIIEAVNTIFGQYRIVPILVQLISD

SEQ ID NO: 742 - protein, 620 aa, Salem salemvirus
  attachment glycoprotein
MKAMHYYKNDFADPGTNDNSSDLTTNPFISNQIKSNLSPPVLAEGHLSPSPIPKFRKILLTISFVSTIVVLTVILLVLTIRILTIIEASAGDEKDIHTILSSLLNTFMNEYIPVFKNLVSIISLQIPQMLIDLKTSSTQMMQSLKTFPRDLETLSTVTQSVAVLLEKAKSTIPDINKFYKNVGKVTFNDPNIKVLTLEVPAWLPIVRQCLKQDFRQVISNSTGFALIGALPSQLFNEFEGYPSLAIVSEVYAITYLKGVMFENQENFLYQYFEIGTISPDGYNKPYFLRHTSVMLSTFKLSGKCTAAVDYRGGIFLCTPSPKIPKILQNPPDLPTLTVVSIPFDGRYTIRNISLMLTDEADIIYDLDTLQGRGVLQAMRFYALVRVISSSSPRHFPFCKNSWCPTADDKICDQSRRLGADGNYPVMYGLISIPAHSSYQGNVSLKLIDPKYYAYTRDASLFYNSMTDTYHYSFGTRGWVSRPIIGELLLGDDIVLTRYTVRSVSRATAGDCTTVSMCPQACSGGMNSIFYPLNFDKPQVTGVAIRQYERQQEGIIVVTMNDHYYYSVPIIKNGTLLISSVTDCFWLMGDLWCMSLMEKNNLPLGVRSLAHLTWNIHWSCS

SEQ ID NO: 743 - protein, 579 aa, Avian orthoavulavirus 9
  hemagglutinin-neuraminidase
MESGISQASLVNDNIELRNTWRTAFRVVSLLLGFTSLVLTACALHFALNAATPADLSSIPVAVDQSHHEILQTLSLMSDIGNKIYKQVALDSPVALLNTESTLMSAITSLSYQINNAANNSGCGAPVHDKDFINGVAKELFVGSQYNASNYRPSRFLEHLNFIPAPTTGKGCTRIPSFDLAATHWCYTHNVILNGCNDHAQSYQYISLGILKVSATGNVFLSTLRSINLDDDENRKSCSISATPLGCDLLCAKVTEREEADYNSDAATRLVHGRLGFDGVYHEQALPVESLFSDWVANYPSVGGGSYFDNRVWFGVYGGIRPGSQTDLLQSEKYAIYRRYNNTCPDNNPTQIERAKSSYRPQRFGQRLVQQAILSIRVEPSLGNDPKLSVLDNTVVLMGAEARIMTFGHVALMYQRGSSYFPSALLYPLSLTNGSAAASKPFIFEQYTRPGSPPCQATARCPNSCVTGVYTDAYPLFWSEDHKVNGVYGMMLDDITSRLNPVAAIFDRYGRSRVTRVSSSSTKAAYTTNTCFKVVKTKRVYCLSIAEIENTLFGEFRITPLLSEIIFDPNLEPSDTSRN

SEQ ID NO: 744 - protein, 595 aa, Achimota pararubulavirus 1
  attachment protein
MATNLSTITNGKFSQNSDEGSLTELPFFEHNRKVATTKRTCRFVFRSVITLCNLTILIVTVVVLFQQAGFIKRTESNQVCETLQNDMHGVVTMSKGVITTLNNLIEITSVNLPFQMKQFGQGIVTQVTQMVRQCNAVCKGPTIGPDIQNIVYPASYESMIKHPVNNSNILLSEIRQPLNFVPNTGKLNGCTRTPSFSVYNGFWCYTHAESDWNCNGSSPYMQVFRVGVVTSDYDYNVIHKTLHTKTSRLANVTYQCSTISTGYECYFLCSTPNVDEITDYKTPGIESLQIYKIDNRGTFAKFPITDQLNKELLTALYPGPGNGVLYQGRLLFPMHGGMQSSELNKVNLNNTVLSQFNDNKGCNATEIKLESEFPGTFTSPYYSNQVMLNYILICEMIENLPGNCDLQIVAPKNMSMGSESQLYSINNKLYLYQRSSSRWPYPLIYEVGTRLTNRQFRLRAINRFLIKSTTRPGSEGCNIYRVCPKVCVTGVYQAPWILHVSKAGSQSIAKVLYAVAWSKDHMSRKGPLFSICDNDTCFLTKSLASEHVHSGYSITRCYLENSERHIICVVIMELDASPWAEMRIQSVIYNITLPS

SEQ ID NO: 745 - protein, 583 aa, Achimota pararubulavirus 2
  attachment protein
MDNSMSISTISLDAQPRIWSRHESRRTWRNIFRITSLVLLGVTVIICIWLCCEVARESELELLASPLGALIMAINTIKSSVVKMTTELNQVTFTTSIILPNKVDQFGQNVVSQVAQLVKQCNAVCRGHQDTPELEQFINQKNPTWILQPNYTTKLTNLHEIDSIIPLVDYPGFSKSCTRFPSFSEGSKFWCFTYAVVKEPCSDISSSIQVVKYGAIKANHSDGNPYLVLGTKVLDDGKFRRGCSITSSLYGCYLLCSTANVSEVNDYAHTPAYPLTLELISKDGITTDLSPTYTVQLDKWSALYPGIGSGVIFKGYLMFPVYGGLPFKSPLISASWVGPGNKWPVDFSCSEDQYSTFNFSNPYSALYSPHFSNNIVVSALFVCPLNENLPYSCEVQVLPQGNLTIGAEGRLYVIDQDLYYYQRSTSWWPYLQLYKLNIRITNRVFRVRSLSLLPIKSTTRPGYGNCTYFKLCPHICVTGVYQSPWLISIRDKRPHEEKNILYFIGWSPDEQIRQNPLVSLCHETACFINRSLATNKTHAGYSESHCVQSFERNKLTCTVFYELTAKPWAEMRVQSLLFQVDFL

SEQ ID NO: 746 - protein, 580 aa, Tuhoko pararubulavirus 1
  hemagglutinin-neuraminidase
MDSRSDSFTDIPLDNRIERTVTSKKTWRSIFRVTAIILLIICVVVSSISLNQHNDAPLNGAGNQATSGFMDAIKSLEKLMSQTINELNQVVMTTSVQLPNRITKFGQDILDQVTQMVRQCNAVCRGPGVGPSIQNYVIQGHAPTVSFDPISAEYQKFVFGITEKTLITAYHNPWECLRFPSQHLFDTTWCVSYQILTQNCSDHGPRITVIQLGEIMIANNLSTVFRDPVIKYIRHHIWLRSCSVVAYYSQCTIFCTSTNKSEPSDYADTGYEQLFLATLQSDGTFTEHSMHGVNIVHQWNAIYGGVGNGVIIGRNMLIPLYGGINYYDHNTTIVQTVDLRPYPIPDSCSQTDNYQTNYLPSMFTNSYYGTNLVVSGYLSCRLMAGTPTSCSIRVIPIENMTMGSEGQFYLINNQLYYYKRSSNWIRDTQVYLLSYSDKGNIIEITSAERYIFKSVTSPDEGDCVTNHGCPSNCIGGLFQAPWILNDFKLCGSNITCPKIVTVWADQPDKRSNPMLSIAETDKLLLHKSYINYHTAVGYSTVLCFDSPKLNLKTCVVLQELMSDDKLLIRISYSIVSIMVE

SEQ ID NO: 747 - protein, 607 aa, Phocine morbillivirus
  hemagglutinin protein
MFSHQDKVGAFYKNNARANSSKLSLVTDEVEERRSPWFLSILLILLVGILILLAITGIRFHQVVKSNLEFNKLLIEDMEKTKAVHHQVKDVLTPLFKIIGDEVGLRLPQKLNEIKQFIVQKTNFFNPNREFDFRELHWCINPPSKVKVNFTQYCEITEFKEATRSVANSILLLTLYRGRDDIFPPYKCRGATTSMGNVFPLAVSLSMSLISKPSEVINMLTAISEGIYGKTYLLVTDDTEENFETPEIRVFEIGFINRWLGDMPLFQTTNYRIISNNSNTKICTIAVGELALASLCTKESTILLNLGDEESQNSVLVVILGLFGATHMDQLEEVIPVAHPSIEKIHITNHRGFIKDSVATWMVPALALSEQGEQINCLRSACKRRTYPMCNQTSWEPFGDKRLPSYGRLTLSLDVSTDLSINVSVAQGPIIFNGDGMDYYEGTLLNSGWLTIPPKNGTILGLINQASKGDQFIVTPHILTFAPRESSTDCHLPIQTYQIQDDDVLLESNLVVLPTQSFEYVVATYDVSRSDHAIVYYVYDPARTVSYTYPFRLRTKGRPDILRIECFVWDGHLWCHQFYRFQLDATNSTSVVENLIRIRFSCDRLDP

SEQ ID NO: 748 - protein, 574 aa, Caprine respirovirus 3
  hemagglutinin-neuraminidase
MEYWGHTNNPDKINRKVGVDQVRDRSKTLKIITFIISMMTSIMSTVALILILIMFIQNNNNNRIILQELRDETDAIEARIQKASNDIGVSIQSGINTRLLTIQNHVQNYIPLALTQQVSSLRESINDVITKREETQSKMPIQRMTHDDGIEPLIPDNFWKCPSGIPTISASPKIRLIPGPGLLATSTTINGCIRLPSLVINNLIYAYTSNLITQGCQDIGKSYQVLQIGIITINSDLVPDLNPRITHTFDIDDNRKSCSLALRNADVYQLCSTPKVDERSDYSSIGIEDIVLDIVTSEGTVSTTRFTNNNITFDKPYAALYPSVGPGIYYDNKIIFLGYGGLEHEENGDVICNITGCPGKTQHDCNQASYSPWFSNRRMVNAIILVNKGLNKVPSLQVWTIPMRQNYWGSEGRLLLLGNKIYIYTRSTSWHSKLQLGTLDISNYNDIRIRWTHHDVLSRPGSEECPWGNTCPRGCITGVYNDAYPLNPSGSVVSSVILDSRTSRENPIITYSTDTSRVNELAIRNNTLSAAYTTTNCVTHYGKGYCFHIIEINHKSLNTLQPMLFKTEIPKSCN

SEQ ID NO: 749 - protein, 414 aa, Avian metapneumovirus
  attachment glycoprotein
MGSELYIIEGVSSSEIVLKQVLRRSKKILLGLVLSALGLTLTSTIVISICISVEQVKLRQCVDTYWAENGSLHPGQSTENTSTRGKTTTKDPRRLQATGAGKFESCGYVQVVDGDMHDRSYAVLGGVDCLGLLALCESGPICQGDTWSEDGNFCRCTFSSHGVSCCKKPKSKATTAQRNSKPANSKSTPPVHSDRASKEHNPSQGEQPRRGPTSSKTTIASTPSTEDTAKPTISKPKLTIRPSQRGPSGSTKAASSTPSHKTNTRGTSKTTDQRPRTGPTPERPRQTHSTATPPPTTPIHKGRAPTPKPTTDLKVNPREGSTSPTAIQKNPTTQSNLVDCTLSDPDEPQRICYQVGTYNPSQSGTCNIEVPKCSTYGHACMATLYDTPFNCWRRTRRCICDSGGELIEWCCTSQ

SEQ ID NO: 750 - protein, 665 aa, Tupaia narmovirus
  hemagglutinin
MDYHSHTTQTGSNETLYQDPLQSQSGSRDTLDGPPSTLQHYSNPPPYSEEDQGIDGPQRSQPLSTPHQYDRYYGVNIQHTRVYNHLGTIYKGLKLAFQILGWVSVIITMIITVTTLKKMSDGNSQDSAMLKSLDENFDAIQEVANLLDNEVRPKLGVTMTQTTFQLPKELSEIKRYLLRLERNCPVCGTEATPQGSKGNASGDTAFCPPCLTRQCSEDSTHDQGPGVEGTSRNHKGKINFPHILQSDDCGRSDNLIVYSINLVPGLSFIQLPSGTKHCIIDVSYTFSDTLAGYLIVGGVDGCQLHNKAIIYLSLGYYKTKMIYPPDYIAIATYTYDLVPNLRDCSIAVNQTSLAAICTSKKTKENQDFSTSGVHPFYIFTLNTDGIFTVTVIEQSQLKLDYQYAALYPATGPGIFIGDHLVFLMWGGLMTKAEGDAYCQASGCNDAHRTSCNIAQMPSAYGHRQLVNGLLMLPIKELGSHLIQPSLETISPKINWAGGHGRLYYNWEINTTYIYIEGKTWRSRPNLGIISWSKPLSIRWIDHSVARRPGARPCDSANDCPEDCLVGGYYDMFPMSSDYKTAITIIPTHHQWPSSPALKLFNTNREVRVVMILRPPNNVKKTTISCIRIMQTNWCLGFIIFKEGNNAWGQIYSYIYQVESTCPNTK

SEQ ID NO: 751 - protein, 585 aa, Avian metapneumovirus
  attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPTRPSSKSPTTTQAIAQLTTPTTPKASTAPKNRQATTKKTETDTTTASRARNTNNPTETATTTPKATTETGKSKEGPTQHTTKEQPETTAGETTTPQPRRTASRPAPTTKIEEEAETTKTRTTKSTQTSTGPPRPTGGAPSGAATEGSGRAAAAGGPSAASAGGRRRTEAAAERDRRTRAGAGPTAGGARARTAAASERGADTAGSAGGGPGGDGATGGLSGGAPAEREDASGGTAAAGPGDGTEADGRAPPAAALAGRTTESAAGAAGDSGRAGTAGWGSAADGRSTGGNAAAEAGAAQSGRAAPRQPSGGTAPESTAPPNSGGSGRADAAPTEEVGVGSGLWRGRYVCGPCGESVPEHPMNPCFGDGTAWICSDDGGSLPAGCYDGGTDGVVCCGVCGGNSCCCGRVECTCGGGAGLLSCCCGSYSWS

SEQ ID NO: 752 - protein, 577 aa, Avian paraavulavirus 3
  hemagglutinin-neuraminidase protein
MESPPSGKDAPAFREPKRTCRLCYRATTLSLNLTIVVLSIISIYVSTQTGANNSCVNPTIVTPDYLTGSTTGSVEDLADLESQLREIRRDTGINLPVQIDNTENLILTTLASINSNLRFLQNATTESQTCLSPVNDPRFVAGINRIPAGSMAYNDFSNLIEHVNFIPSPTTLSGCTRIPSFSLSKTHWCYTHNVISNGCLDHAASSQYISIGIVDTGLNNEPYFRTMSSKSLNDGLNRKSCSVTAAANACWLLCSVVTEYEAADYRSRTPTAMVLGRFDFNGEYTEIAVPSSLFDGRFASNYPGVGSGTQVNGTLYFPLYGGVLNGSDIETANKGKSFRPQNPKNRCPDSEAIQSFRAQDSYYPTRFGKVLIQQAIIACRISNKSCTDFYLLYFDNNRVMMGAEARLYYLNNQLYLYQRSSSWWPHPLFYSISLPSCQALAVCQITEAHLTLTYATSRPGMSICTGASRCPNNCVDGVYTDVWPLTKNDAQDPNLFYTVYLNNSTRRISPTISLYTYDRRIKSKLAVGSDIGAAYTTSTCFGRSDTGAVYCLTIMETVNTIFGQYRIVPILLRVTSR

SEQ ID NO: 753 - protein, 585 aa, Avian metapneumovirus
  attachment glycoprotein
MEVKVENVGKSQELKVKVKNFIKRSDCKKKLFALILGLVSFELTMNIMLSVMYVESNEALSLCRIQGTPAPRDNKTNTENATKETTLHTTTTTRDPEVRETKTTKPQANEGATNPSRNLTTKGDKHQTTRATTEAELEKQSKQTTEPGTSTQKHTPARPSSKSPTTTQATAQPTTPTAPKASTAPKNRQATTKKTETDTTTASRARNTNNPTETATTTPKATTETGKGKEGPTQHTTKEQPETTARETTTPQPRRTASRPAPTTKIEEEAETTKTRTTKNTQTSTGPPRPTRSTPSKTATENNKRTTTTKRPNTASTDSRQQTRTTAEQDQQTQTRAKPTTNGAHPQTTTTPEHNTDTTNSTKGSPKEDKTTRDPSSKTPTEQEDASKGTAAANPGGSAEADRRAPPATTPTGRTTESAAGTTGDDSGAETTRRRSAADRRPTGGSTAAEAGTAQSGRATPKQPSGGTAAGNTAPPNNESSGRADAAPAEEAGVGPSIRRGRHACGPRRESAPEHPTNPCPGDGTAWTRSDGGGNLPAGRHDSGADGAARRGARGGNPRRRGRAERTRGGGAGPPSCRCGSHNRS

SEQ ID NO: 754 - protein, 389 aa, Avian metapneumovirus
  attachment glycoprotein
MGAKLYAISGASDAQLMKKTCAKLLEKVVPIIILAVLGITGTTTIALSISISIERAVLSDCTTQLRNGTTSGSLSNPTRSTTSTAVTTRDIRGLQTTRTRELKSCSNVQIAYGYLHDSSNPVLDSIGCLGLLALCESGPFCQRNYNPRDRPKCRCTLRGKDISCCKEPPTAVTTSKTTPWGTEVHPTYPTQVTPQSQPATMAHQTATANQRSSTTEPVGSQGNTTSSNPEQQTEPPPSPQHPPTTTSQDQSTETADGQEHTPTRKTPTATSNRRSPTPKRQETGRATPRNTATTQSGSSPPHSSPPGVDANMEGQCKELQAPKPNSVCKGLDIYREALPRGCDKVLPLCKTSTIMCVDAYYSKPPICFGYNQRCFCMETFGPIEFCCKS

SEQ ID NO: 755 - protein, 197 aa, Unknown
  Description of Unknown: Respiratory syncytial virus sequence
MSKNKNQRTARTLEKTWDTLNHLIVISSCLYKLNLKSIAQIALSVLAMIISTSLIIAAIIFIISANHKVTLTTVTVQTIKNHTEKNITTYLTQVSPERVSPSKQPTTTPPIHTNSATISPNTKSEIHHTTAQTKGRTSTPTQNNKPNTKPRPKNPPKKDDYHFEVFNFVPCSICGNNQLCKSICKTIPSNKPRKNQP

SEQ ID NO: 756 - protein, 580 aa, Avian metaavulavirus 14
  hemagglutinin-neuraminidase protein
MEGSRTVIYQGDPNEKNTWRLVFRTLTLILNLAILSVTIASIIITSKITLSEVTTLKTEGVEEVITPLMATLSDSVQQEKMIYKEVAISIPLVLDKIQTDVGTSVAQITDALRQIQGVNGTQAFALSNAPEYSGGIEVPLFQIDSFVNKSMSISGLLEHASFIPSPTTLHGCTRIPSFHLGPRHWCYTHNIIGSRCRDEGFSSMYISIGAITVNRDGNPLFITTASTILADDNNRKSCSIIASSYGCDLLCSIVTESENDDYANPNPTKMVHGRFLYNGSYVEQALPNSLFQDKWVAQYPGVGSGITTHGKVLFPIYGGIKKNTQLFYELSKYGFFAHNKELECKNMTEEQIRDIKAAYLPSKTSGNLFAQGIIYCNISKLGDCNVAVLNTSTTMMGAEGRLQMMGEYVYYYQRSSSWWPVGIVYKKSLAELMNGINMEVLSFEPIPLSKFPRPTWTAGLCQKPSICPDVCVTGVYTDLFSVTIGSTTDKDTYFGVYLDSATERKDPWVAAADQYEWRNRVRLFESTTEAAYTTSTCFKNTVNNRVFCVSIVELRENLLGDWKIVPLLFQIGVSQGPPPK

SEQ ID NO: 757 - protein, 1046 aa, Beilong jeilongvirus
  attachment glycoprotein
MSQLAAHNLAMSNFYGTHQGDLSGSQKGEEQQVQGVIRYVSMIVGLLSLFTIIALNVTNIIYMTESGGTMQSIKTAQGSIDGSMREISGVIMEDVKPKTDLINSMVSYNIPAQLSMIHQIIKNDVLKQCTPSFMFNNTICPLAENPTHSRYFEEVNLDSISECSGPDMHLGLGVNPEFIEFPSFAPGSTKPGSCVRLPSFSLSTTVFAYTHTIMGHGCSELDVGDHYFSVGRIADAGHEIPQFETISSWFINDKINRRSCTVAAGAMEAWMGCVIMTETFYDDLNSLDTGKLTISYLDVFGRKKEWIYTRSEILYDYTYTSVYFSVGSGVVVGDTVYFLIWGSLSSPIEETAYCFAPDCSNYNQRMCNEAQRPSKFGHRQMVNGILKFKTTSTGKPLLSVGTLSPSVVPFGSEGRLMYSEITKIIYLYLRSTSWHALPLTGLFVLGPPTSISWIVQRAVSRPGEFPCGASNRCPKDCVTGVYTDLFPLGSRYEYAATVYLNSETYRVNPTLALINQTNIIASKKVTTESQRAGYTTTTCFVFKLRVWCISVVELAPSTMTAYEPIPFLYQLDLTCKGKNGSLAMRFTGKEGTYKSGRYKSPRNECFFEKVSNKYYFIVSTPEGIQPYEIRDLTPDRMPHIIMYISDVCAPALSAFKKLLPAMRPITTLTIGNWQFRPVEVSGGLRVSIGRNLTKEGDLTMSAPEDPGSNTFPGGHIPGNGLFDAGYYTVEYPKEWKQTTPKPSEGGNIIDKNKTPVIPSRDNPTSDSSIPHRESIEPVRPTREVLKSSDYVTIVSTDSGSGSGDFATGVPWTGVSPKAPQNGINLPGTELPHPTVLDRINTPAPSDPKVSADSDHTRDTIDPTALSKPLNHDTTGDTDTRINTGTATYGFTPGREATSSGKLANDLTNSTSVPSEAHPSASTSEASKPEKNTDNRVTQDPTSGTAERPTTNAPVDGKHSTQLTDARPNTADPERTSQHSSSTTRDEVKPSLPSTTEASTHQRTEAATPPELVNNTLNPPSTQVRSVRSLMQDAIAQAWNFVRGVTP

SEQ ID NO: 758 - protein, 618 aa, Avian orthoavulavirus 16
  hemagglutinin-neuraminidase protein
MERGISEVALANDRTEEKNTWRLIFRITVLVVSVITLGLTAASLVYSMNAAQPADFDGIIPAVQQVGTSLTNSIGGMQDVLDRTYKQVALESPLTLLNMESTIMNAITSLSYKINNGGNSSGCGAPIHDPEYIGGIGKELLIDDNVDVTSFYPSAFKEHLNFIPAPTTGAGCTRIPSFDLSATHYCYTHNVILSGCQDHSHSHQYIALGVLKLSDTGNVFFSTLRSINLDDTANRKSCSISATPLGCDILCSKVTETELEDYKSEEPTPMVHGRLSFDGTYSEKDLDVNNLFSDWTANYPSVGGGSYIGNRVWYAVYGGLKPGSNTDQSQRDKYVIYKRYNNTCPDPEDYQINKAKSSYTPSYFGSKRVQQAILSIAVSPTLGSDPVLTPLSNDVVLMGAEGRVMHIGGYTYLYQRGTSYYSPALLYPLNIQDKSATASSPYKFDAFTRPGSVPCQADARCPQSCVTGVYTDPYPLIFAKDHSIRGVYGMMLNDVTARLNPIAAVFSNISRSQITRVSSSSTKAAYTTSTCFKVIKTNRIYCMSIAEISNTLFGEFRIVPLLVEILSNGGNTARSAGGTPVKESPKGWSDAIAEPLFCTPTNVTRYNADIRRYAYSWP

SEQ ID NO: 759 - protein, 576 aa, Aquaparamyxovirus
  hemagglutinin-neuraminidase protein
MPPAPSPVHDPSSFYGSSLFNEDTASRKGTSEEIHLLGIRWNTVLIVLGLILAIIGIGIGASSFSASGITGNTTKEIRLIVEEMSYGLVRISDSVRQEISPKVTLLQNAVLSSIPALVTTETNTIINAVKNHCNSPPTPPPPTEAPLKKHETGMAPLDPTTYWTCTSGTPRFYSSPNATFIPGPSPLPHTATPGGCVRIPSMHIGSEIYAYTSNLIASGCQDIGKSYQNVQIGVLDRTPEGNPEMSPMLSHTFPINDNRKSCSIVTLKRAAYIYCSQPKVTEFVDYQTPGIEPMSLDHINANGTTKTWIYSPTEVVTDVPYASMYPSVGSGVVIDGKLVFLVYGGLLNGIQVPAMCLSPECPGIDQAACNASQYNQYLSGRQVVNGIATVDLMNGQKPHISVETISPSKNWFGAEGRLVYMGGRLYIYIRSTGWHSPIQIGVIYTMNPLAITWVTNTVLSRPGSAGCDWNNRCPKACLSGVYTDAYPISPDYNHLATMILHSTSTRSNPVMVYSSPTNMVNYAQLTTTAQIAGYTTTSCFTDNEVGYCATALELTPGTLSSVQPILVMTKIPKECV

SEQ ID NO: 760 - RNA, 21 nt, Artificial Sequence
  Description of Artificial Sequence: Synthetic oligonucleotide
gacguaaacggccacaaguuc

SEQ ID NO: 761 - RNA, 21 nt, Artificial Sequence
  Description of Artificial Sequence: Synthetic oligonucleotide
acuuguggccguuuacgucgc

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
ucgaaguacucagcguaagtt

SEQ ID NO: 764 - DNA, 20 bp, Artificial Sequence
  Description of Artificial Sequence: Synthetic oligonucleotide
gaagttcgagggcgacaccc

SEQ ID NO: 765 - DNA, 20 bp, Artificial Sequence
  Description of Artificial Sequence: Synthetic oligonucleotide
gcactaccagagctaactca

SEQ ID NO: 766 - protein, 4 aa, Unknown
  Description of Unknown: DEAD box motif sequence
DEAD

What is claimed is:

1. A fusosome comprising:

(a) a lipid bilayer comprising a plurality of lipids obtained from a source cell;

(b) a lumen surrounded by the lipid bilayer;

(c) a fusogen that is exogenous or overexpressed relative to the source cell, wherein the fusogen is disposed in the lipid bilayer, and wherein the fusogen comprises a paramyxoviral fusogen; and (d) a nuclear payload agent for delivery to the nucleus of a target cell, wherein the nuclear payload agent comprises or encodes a protein having a nuclear localization signal (NLS).

2. The fusosome of claim 1, wherein the nuclear protein payload agent comprises a nuclear localization signal set forth in any one of SEQ ID NOS: 128-507 and 605-626.

3. The fusosome of claim 1, wherein:

the nuclear payload agent comprises or encodes: a nuclease, a transcription factor, a recombinase, an epigenetic factor, a post-transcriptional RNA modification factor, a non-coding RNA or ribonucleic protein, or a structural protein;

the nuclear payload agent comprises or encodes one or more of a transcriptional activator, transcriptional repressor, epigenetic modifier, histone acetyltransferase, histone deacetylase, histone methyltransferase, DNA methyltransferase, a DNA nickase, a site-specific DNA editing enzyme, optionally a deaminase, DNA transposase, DNA integrase, an RNA editor, an RNA splicing factor, or a PIWI protein; or the nuclear payload agent comprises or encodes an antibody molecule, e.g., a Fab, an scFv, an scFab, a sdAb, a duobody, a minibody, a nanobody, a diabody, a zybody, a camelid antibody, a BiTE, a quadroma, or a bsDb.

4. The fusosome of claim 1, wherein the source cell is a primary cell, a cultured cell, an immortalized cell, or a cell line.

5. The fusosome of claim 1, wherein the source cell is allogeneic.

6. The fusosome of claim 1, wherein the source cell is autologous.

7. The fusosome of claim 1, wherein the fusosome is from a source cell having a modified genome that exhibits reduced immunogenicity.

8. The fusosome of claim 1, wherein the fusosome:

(i) has a diameter that is less than about 0.01% or 1% of that of the source cell;

(ii) is active at a pH of 6-8.

9. The fusosome of claim 1, wherein the fusosome comprises a targeting domain which localizes the fusosome to a target cell.

10. The fusosome of claim 9, wherein the targeting domain interacts with a target cell moiety on the target cell.

11. The fusosome of claim 1, wherein the target cell is in an organism or is a primary cell isolated from an organism.

12. The fusosome of claim 1, wherein the target cell is selected from an endothelial cell, a fibroblast, a blood cell, a stem cell, an embryonic stem cell, a myoblast, a parenchymal cell, an alveolar cell, a neuron, a precursor cell, a progenitor cell, or an immortalized cell.

13. A pharmaceutical composition comprising the fusosome of claim 1.

14. The fusosome of claim 1, wherein when contacted with a target cell population, the fusosome delivers the payload agent via a non-endocytic pathway.

15. The fusosome of claim 14, wherein the level of payload delivered via a non-endocytic pathway for a given fusosome composition is 0.1-0.95, 0.1-0.2, 0.2-0.3, 0.3-0.4, 0.4-0.5, 0.5-0.6, 0.6-0.7, 0.7-0.8, 0.8-0.9, 0.9-0.95, or at least 1%, 2%, 3%, 4%, 5%, 10%, 20%, 30%, 40%, 50%, 60%, 70%, 80%, 90% or greater than a chloroquine treated reference cell.

16. The fusosome of claim 1, wherein the paramyxovirus fusogen comprises a Nipah virus protein F, a measles virus F protein, a tupaia paramyxovirus F protein, a paramyxovirus F protein, a Hendra virus F protein, a Henipavirus F protein, a Morbilivirus F protein, a respirovirus F protein, a Sendai virus F protein, a rubulavirus F protein, or an avulavirus F protein.

17. The fusosome of claim 9, wherein the fusogen comprises the targeting domain.

* * * * *